(12) United States Patent
Misher et al.

(10) Patent No.: US 8,632,774 B2
(45) Date of Patent: *Jan. 21, 2014

(54) ANTAGONISTS OF IL-6

(75) Inventors: Lynda Misher, Seattle, WA (US); Alan Keith Lofquist, Kirkland, WA (US); Peter Robert Baum, Seattle, WA (US); Peter Armstrong Thompson, Bellevue, WA (US)

(73) Assignee: Emergent Product Development Seattle, LLC, Seattle, WA (US)

( * ) Notice: Subject to any disclaimer, the term of this patent is extended or adjusted under 35 U.S.C. 154(b) by 0 days.

This patent is subject to a terminal disclaimer.

(21) Appl. No.: 13/001,084

(22) PCT Filed: Jul. 2, 2009

(86) PCT No.: PCT/US2009/049593
§ 371 (c)(1),
(2), (4) Date: Feb. 10, 2011

(87) PCT Pub. No.: WO2010/003101
PCT Pub. Date: Jan. 7, 2010

(65) Prior Publication Data
US 2011/0142851 A1      Jun. 16, 2011

Related U.S. Application Data

(60) Provisional application No. 61/077,859, filed on Jul. 2, 2008.

(51) Int. Cl.
*A61K 39/395* (2006.01)

(52) U.S. Cl.
USPC .................. 424/133.1; 424/143.1; 424/145.1; 530/388.22; 530/388.23; 530/387.3; 530/351

(58) Field of Classification Search
None
See application file for complete search history.

(56) References Cited

U.S. PATENT DOCUMENTS

| | | | |
|---|---|---|---|
| 5,670,373 A | 9/1997 | Kishimoto | |
| 5,919,763 A | 7/1999 | Galun et al. | |
| 6,820,575 B2 | 11/2004 | Ashton, III et al. | |
| 7,198,781 B1 | 4/2007 | Revel et al. | |
| 7,291,721 B2 | 11/2007 | Giles-Komar et al. | |
| 7,531,644 B2 | 5/2009 | Ekida et al. | |
| 7,754,208 B2 | 7/2010 | Ledbetter et al. | |
| 7,820,155 B2 | 10/2010 | Way | |
| 8,153,128 B2* | 4/2012 | Bowers et al. | 424/141.1 |
| 2003/0133939 A1 | 7/2003 | Ledbetter et al. | |
| 2006/0024297 A1* | 2/2006 | Wood et al. | 424/133.1 |
| 2007/0172458 A1 | 7/2007 | Jones et al. | |
| 2009/0269335 A1 | 10/2009 | Nakashima et al. | |
| 2009/0304696 A1* | 12/2009 | Lawson et al. | 424/135.1 |
| 2010/0098709 A1* | 4/2010 | Bowers et al. | 424/158.1 |
| 2011/0038877 A1 | 2/2011 | Way et al. | |
| 2011/0152173 A1 | 6/2011 | Lofquist et al. | |
| 2011/0158995 A1 | 6/2011 | Tan et al. | |
| 2011/0177070 A1 | 7/2011 | Lofquist et al. | |
| 2011/0217302 A1 | 9/2011 | Odegard et al. | |
| 2012/0100139 A1 | 4/2012 | Thompson et al. | |

FOREIGN PATENT DOCUMENTS

| | | |
|---|---|---|
| DE | 103 21 317 A1 | 12/2004 |
| EP | 1 967 209 A1 | 9/2008 |
| WO | WO 2007/061029 A1 | 5/2007 |
| WO | WO 2007/146968 A2 | 12/2007 |
| WO | WO 2008/065384 A2 | 6/2008 |
| WO | WO 2008/071685 A1 | 6/2008 |
| WO | WO 2009/109584 A1 | 9/2009 |
| WO | WO 2011/079308 A2 | 6/2011 |
| WO | WO 2011/090754 A1 | 7/2011 |
| WO | WO 2011/090761 A1 | 7/2011 |
| WO | WO 2011/090762 A1 | 7/2011 |

OTHER PUBLICATIONS

Badache, A. and Hynes, N., "Interleukin 6 inhibits proliferation and, in cooperation with an epidermal growth factor receptor autocrine loop, increases migration of T47D breast cancer cells," *Cancer Res.* 61:383-391, American Association for Cancer Research, United States (2001).

Benigni, F., et al., "Six different cytokines that share GP130 as a receptor subunit, induce serum amyloid A and potentiate the induction of interleukin-6 and the activation of the hypothalamus-pituitary-adrenal axis by interleukin-1," *Blood* 87(5):1851-1854, American Society of Hematology, United States (1996).

Bockermann, R., et al., "Induction of B-cell-dependent chronic arthritis with glucose-6-phosphate isomerase," *Arthritis Res. Ther.* 7:R1316-R1324, BioMed Central Ltd, United Kingdom, United Kingdom (2005).

Boulanger, M., et al.,"Hexameric structure and assembly of the interleukin-6/IL-6 α-receptor/gp130 complex," *Science* 300(27):2101-2104, National Academy of Sciences, United States (2003).

Croucher, P., et al., "Osteoprotegerin inhibits the development of osteolytic bone disease in multiple myeloma," *Blood* 98(13):3534-3540, American Society of Hematology, United States (2001).

Diamant, M., et al., "Cloning and expression of an alternatively spliced mRNA encoding a soluble form of the human interleukin-6 signal transducer gp130," *FEBS Lett.* 412:379-384, Federation of European Biochemical Societies, Netherlands (1997).

Diaz-Borjon, A., et al., "Treatment of chronic inflammatory diseases with biologic agents: Opportunities and risks for the elderly," *Exp. Gerontol.* 41:1250-1255, Elsevier Inc., United States (2006).

Fischer, M., et al., "A bioactive designer cytokine for human hematopoietic progenitor cell expansion," *Nat. Biotechnol.* 15:142-145, Nature Publishing Group, United Kingdom(1997).

(Continued)

*Primary Examiner* — Dong Jiang
(74) *Attorney, Agent, or Firm* — Sterne, Kessler, Goldstein & Fox P.L.L.C.

(57) ABSTRACT

A binding domain polypeptide and fusion proteins thereof that recognize an IL6/IL6 receptor complex, as well as compositions and methods of use thereof.

12 Claims, 18 Drawing Sheets

(56) References Cited

OTHER PUBLICATIONS

Gaillard, J., et al., "Interleukin-6 receptor signaling. II. Bio-availability of interleukin-6 in serum," *Eur. Cytokine Netw.* 10(3):337-343, John Libbey Eurotext Ltd., France (1999).

Gattone, V., et al., "Inhibition of renal cystic disease development and progression by a vasopressin V2 receptor antagonist," *Nat. Med.* 9(10):1323-1326, Nature Publishing Group, United Kingdom (2003).

Graff, C., et al., "Directed evolution of an anti-carcinoembryonic antigen scFv with a 4-day monovalent dissociation half-time at 37° C.," *Protein Eng. Des. Sci.* 17(4):293-304, Oxford University Press, United Kingdom (2004).

Grant, S., et al., "An unexpected biochemical and functional interaction between gp130 and the EGF receptor family in breast cancer cells," *Oncogene* 21:460-474, Nature Publishing Group, United Kingdom (2002).

Hoet, R., et al., "Generation of high-affinity human antibodies by combining donor-derived and synthetic complementarity-determining-region diversity," *Nat. Biotechnol.* 23:1-5, Nature Publishing Group, United Kingdom (2005).

Iwanami, K., et al., "Crucial role of the interleukin-6/interleukin-17 cytokine axis in the induction of arthritis by glucose-6-phosphate isomerase," *Arthritis Rheum.* 58(3):754-763, Wiley-Liss, Inc., American College of Rheumatology (2008).

Jermutus, L., et al., "Tailoring in vitro evolution for protein affinity or stability," *Proc. Natl. Acad. Sci.* 98(1):75-80, National Academy of Sciences, United States (2001).

Jirholt, J., et al., "The genetics of rheumatoid arthritis and the need for animal models to find and understand the underlying genes," *Arthritis Res.* 3(2):87-97, BioMed Central Ltd, United Kingdom (2001).

Jones, S., et al., "IL-6 transsignaling: the in vivo consequences," *J. Interferon Cytokine Res.* 25:241-253, Mary Ann Liebert, Inc., United States (2005).

Jostock, T., et al., "Soluble gp130 is the natural inhibitor of soluble interleukin-6 receptor transsignaling responses," *Eur. J. Biochem.* 268:160-167, FEBS, United Kingdom (2001).

Kalai, M., et al., "Analysis of the mechanism of action of anti-human interleukin-6 and anti-human interleukin-6 receptor-neutralising monoclonal antibodies," *Eur. J. Biochem.* 249:690-700, FEBS, United Kingdom (1997).

Kalergis, A., et al., "Efficient T cell activation requires an optimal dwell-time of interaction between the TCR and the pMHC complex," *Nat. Immunol.* 2(3):229-234, Nature Publishing Group, United Kingdom (2001).

Kamradt, T. and Schubert, D., "The role and clinical implications of G6PI in experimental models of rheumatoid arthritis," *Arthritis Res. Ther.* 7(1):20-28, BioMed Central, United Kingdom (2005)

Lu, Z., et al., "Overall interleukin-6 production exceeds 7 mg/day in multiple myeloma complicated by sepsis," *Cytokine* 5(6):578-582, Academic Press Limited, United States (1993).

Lyons, D., et al., "A TCR binds to antagonist ligands with lower affinities and faster dissociation rates than to agonists," *Immunity* 5:53-61, Cell Press, United States (1996).

Matsui, K., et al., "Kinetics of T-cell receptor binding to peptide/I-E$^k$ complexes: correlation of the dissociation rate with T-cell responsiveness," *Proc. Natl. Acad. Sci. USA* 91:12862-12866, National Academy of Sciences, United States (1994).

Matsumoto, I., et al., "Therapeutic effects of antibodies to tumor necrosis factor-α, interleukin-6 and cytotoxic T-lymphocyte antigen 4 immunoglobulin in mice with glucose-6-phosphate isomerase induced arthritis," *Arthritis Res. Ther.* 10:R66 (8 pages) BioMed Central Ltd., United Kingdom (2008).

Narazaki, M., et al., "Soluble forms of the interleukin-6 signal-transducing receptor component gp130 in human serum possessing a potential to inhibit signals through membrane-anchored gp130," *Blood* 82(4):1120-1126, American Society of Hematology, United States (1993).

Perelson, A., "Receptor clustering on a cell surface. II. Theory of receptor cross-linking by ligands bearing two chemically distinct functional groups," *Math. Biosci.* 49:87-110, Elsevier North Holland, Inc., Netherlands (1980).

Rabe, B., et al., "Transgenic blockade of interleukin 6 transsignaling abrogates inflammation," *Blood* 111(3) :1021-1028, American Society of Hematology, United States (2008).

Radl, J., et al., "Idiopathic paraproteinemia. II. Transplantation of the paraprotein-producing clone from old to young C57BL/KaLwRij mice," *J. Immunol.* 122(2):609-613, The Williams & Wilkins Co., United States (1979).

Radl, J., et al., "Animal model of human disease. Multiple myeloma," *Am. J. Pathol.* 132(3):593-597, American Association of Pathologists, United States (1988).

Radl, J., "Age-related monoclonal gammapathies: clinical lessons from the aging C57BL mouse," *Immunol. Today* 11(7):234-236, Elsevier Science Publishers Ltd., United Kingdom (1990).

Ramadori, G., et al., "Interleukin 6, the third mediator of acute-phase reaction, modulates hepatic protein synthesis in human and mouse. Comparison with interleukin 1 β and tumor necrosis factor-α," *Eur. J. Immunol.* 18:1259-1264, VCH Verlagsgescellschaft mbH, Germany (1988).

Rosloniec, E., et al., "Collagen-Induced Arthritis," in *Current Protocols in Immunology*, pp. 15.5.1-15.5.24, vol. 3, Coligan, J., et al., eds., John Wiley & Sons, Inc., United States (1996).

Sansone, P., et al., "IL-6 triggers malignant features in mammospheres from human ductal breast carcinoma and normal mammary gland," *J. Clin Invest.* 117(12):3988-4002, American Society for Clinical Investigation, United States (2007).

Scheller, J., et al., "Interleukin-6 trans-signalling in chronic inflammation and cancer," *Scand. J. Immunol.* 63:321-329, Blackwell Publishing Ltd., United Kingdom (2006).

Schubert, D., et al., "Immunization with glucose-6-phosphate isomerase indcues T cell-dependent peripheral polyarthritis in genetically unaltered mice," *J. Immunol.* 172:4503-4509, American Association of Immunologists, United States (2004).

Steukers, M., et al., "Rapid kinetic-based screening of human Fab fragments," *J. Immunol. Methods* 310:126-135, Elsevier B.V., Netherlands (2006).

Su, B., et al., "Automated high-throughput purification of antibody fragments facilitate evaluation in functional and kinetic based assays," *J. Immunol. Methods* 322:94-103, Elsevier B.V., Netherlands (2007).

Taga, T., et al., "Interleukin-6 triggers the association of its receptor with a possible signal transducer, gp130," *Cell* 58:573-581, Cell Press, United States (1989).

Torres, V., et al., "Effective treatment of an orthologous model of autosomal dominant polycystic kidney disease," *Nat. Med.* 10(4):363-364, Nature Publishing Group, United Kingdom (2004).

Van Valckenborgh, E., et al., "Murine 5T multiple myeloma cells induce angiogenesis in vitro and in vivo," *Br. J. Cancer* 86:796-802, Cancer Research UK, United Kingdom (2002).

Vanderkerken, K., et al., "Organ involvement and phenotypic adhesion profile of 5T2 and 5T33 myeloma cells in the C57BL/KaLwRij mouse," *Br. J. Cancer* 76(4):451-460, Cancer Research Campaign, United Kingdom (1996).

Van Den Berg, W., "Lessons from animal models of arthritis," *Curr. Rheumatol. Rep.* 4:232-239, Current Science Inc., United States (2002).

Wang, X., et al., "Effectiveness of vasopressin V2 receptor antagonists OPC-31260 and OPC-41061 on polycystic kidney disease development in the PCK rat," *J. Am. Soc. Nephrol.* 16:846-851, American Society of Nephrology, United States (2005).

Wang, Y., et al., "Cooperation between heparin-binding EGF-like growth factor and interleukin-6 in promoting the growth of human myeloma cells," *Oncogene* 21:2584-2592, Nature Publishing Group, United Kingdom (2002).

Wilson, P., "Mouse models of polycystic kidney disease," *Curr. Top. Dev. Biol.* 84:311-350, Elsevier Inc., United States (2008).

International Search Report for International Patent Application No. PCT/US2009/049593, European Patent Office, Netherlands, mailed on Feb. 17, 2010.

\* cited by examiner

ANTAGONISTS OF IL-6

CROSS-REFERENCE TO RELATED APPLICATIONS

The present application is the National Stage Application of International Application No. PCT/US2009/049593, filed Jul. 2, 2009, which claims priority benefit of U.S. Provisional Application No. 61/077,859, filed Jul. 2, 2008, both of which are incorporated herein by reference in their entireties.

REFERENCE TO SEQUENCE LISTING SUBMITTED ELECTRONICALLY VIA EFS-WEB

The content of the electronically submitted sequence listing (Name: sequencelisting_ascii.txt; Size: 1,056,201 bytes; Date of Creation: Feb. 10, 2011) submitted in this application is incorporated herein by reference in its entirety.

BACKGROUND

Interleukin 6 ("IL6") is a pleiotropic cytokine that regulates host immune responses, inflammation, hematopoiesis, and oncogenesis. IL6 biology is mediated by a multicomponent molecular system with two distinct modes of signaling operative on overlapping but non-identical cell populations. These are referred to as cis-signaling (also known as "classical" signaling) and trans-signaling.

In cis-signaling, IL6 binds to cell surface IL6 receptor, the ligand binding part of IL6R that is referred to as IL6Rα or CD126 (previously called gp80). The cell-bound IL6|IL6Rα complex in turn binds to non-ligand binding but signal transducing membrane protein gp130 (also known as IL6ST, IL6Rβ, or CD130), which induces gp130 dimerization and initiation of signaling. Thus, cis-signaling is restricted to the subset of cell types that express cell-surface IL6Rα, which is generally limited to, for example, mitogen-activated B cells, T cell subsets, peripheral monocytes, and certain tumors. The resultant ternary complex on the cell surface assembles into a very stable hexamer with a 2:2:2 ratio of IL6:IL6Rα:gp130 (Boulanger et al. (2003) Science 300:2101).

In trans-signaling, soluble IL6Rα ("sIL6Rα") complexes with IL6 and the resulting circulating sIL6xR complex can bind to and activate any gp130-expressing cell (but not cells also expressing IL6Rα, Taga et al. (1989) Cell 58:573). Many, perhaps all or nearly all, cells in the human body express gp130. Because gp130 is ubiquitous, trans-signaling can affect many cell types and thereby sometimes cause disease.

The membrane protein gp130 also exists in soluble form ("sgp130"), which can bind sIL6xR complex in circulation. But, the sIL6xR complex binds equally well to membrane and soluble gp130 (see Jones et al, (2005) J. Interferon Cytokine Res. 25:241). Therefore, a molar excess of sgp130 can inhibit trans-signaling (by reducing the amount of available sIL6xR complex in circulation), which will not significantly affecting cis-signaling because the affinity of sgp130 is orders of magnitude less, as compared to cell surface gp130, for cell-bound IL6|IL6Rα complex (see, e.g., Jostock et al. (2001) Eur. J. Biochem. 268:160). Thus, it has been suggested that spg130 may be useful in inhibiting IL6 activity (see, e.g., Jostock et al. (2001) Eur. J. Biochem. 268:160). But, in addition to IL6, gp130 is a common signal-transducing protein for a family of gp130 cytokines. These include leukemia inhibitory factor (LIF), ciliary neurotrophic factor (CNTF), neuropoietin (NP), cardiotropin like cytokine (CLC), oncostatin M (OSM), IL-27, IL-31 and cardiotrophin-1 (CT-1). Hence, although sgp130 can inhibit trans-signaling, administering such a compound to patients may have some unintended adverse effects.

Increased production of IL6 has been implicated in various disease processes, including Alzheimer's disease, autoimmunity (e.g., rheumatoid arthritis, SLE), inflammation, myocardial infarction, Paget's disease, osteoporosis, solid tumors (e.g., colon cancer, RCC prostatic and bladder cancers), certain neurological cancers, B-cell malignancies, such as Castleman's disease, some lymphoma subtypes, CLL, and, in particular, multiple myeloma. In some instances, IL-6 is implicated in proliferation pathways because it acts with other factors, such as heparin-binding epithelial growth factor and hepatocyte growth factor.

Several IL6 and IL6Rα antibody antagonists are known. For example, for IL6, Way et al. (US Patent Application Publication No. 2007/0178098) disclose antibodies against IL6 to sterically block IL6 or sIL6xR complex from binding to gp130 (see also U.S. Pat. No. 7,291,721). For example, for IL6Rα, Kishimoto (U.S. Pat. No. 5,670,373) discloses antibodies against IL6Rα that inhibit IL6 activity.

DETAILED DESCRIPTION

Figure 1A:
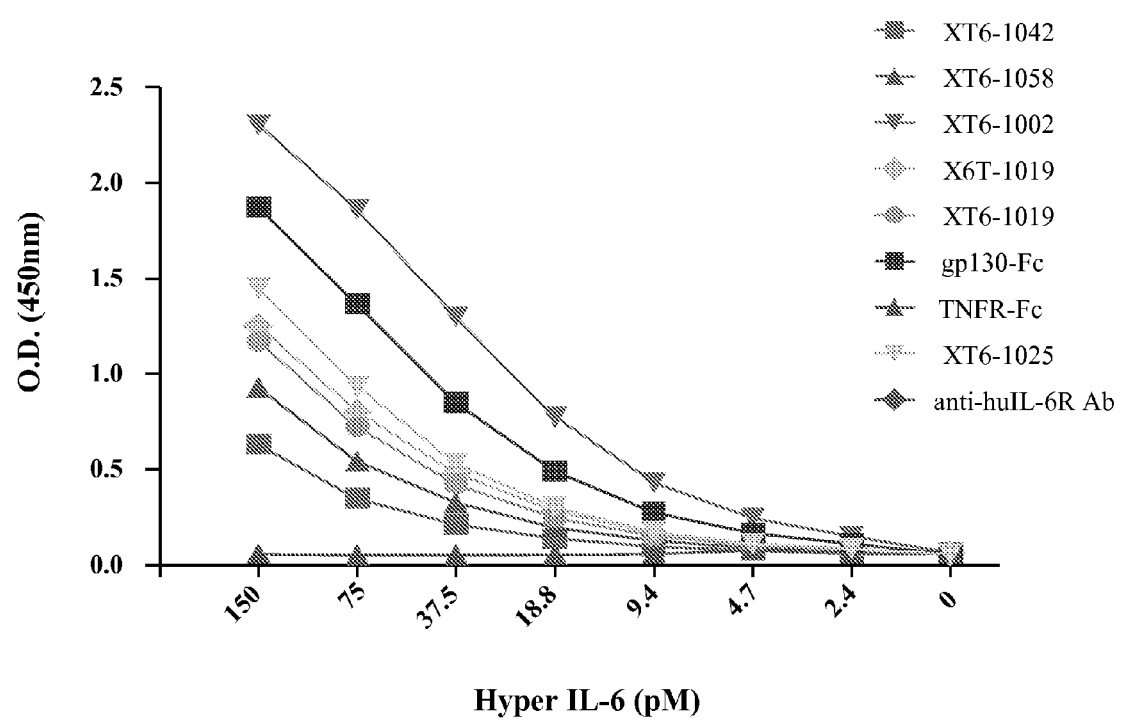
FIGS. 1A-1C show that multi-specific (Xceptor™) fusion proteins containing one of various different Hyper-IL6 binding domains fused to a TNFR ectodomain bind to Hyper-IL6 specifically as measured by ELISA, and that these multi-specific fusion proteins preferentially bind Hyper-IL6 over IL6 and IL6R alone. Only two fusion proteins tested bound IL6 and none bound sIL6R.

The present disclosure generally provides polypeptides containing a binding region or domain specific for a complex of IL6 with membrane or soluble IL6 receptor (IL6Rα) (the complex is referred to herein as IL6xR when referring to either membrane IL6Rα or soluble IL6Rα (sIL6Rα), and sIL6xR is used when referring only to the complex of IL6 with sIL6Rα) that preferentially inhibits IL6 trans-signaling over IL6 cis-signaling by, for example, competing with membrane gp130 for binding with sIL6xR, augmenting soluble gp130 binding with sIL6xR, having greater affinity for an IL6xR complex than for either IL6 or IL6Rα alone, or having any combination of these properties. A binding domain specific for IL6xR would also, in certain embodiments, not inhibit signaling of gp130 family cytokines other than IL6. In other embodiments, such a polypeptide binding domain specific for IL6xR complex may further be part of a fusion protein in which it is fused to the amino- or carboxy-terminus of a dimerization domain (e.g., an immunoglobulin constant region or sub-region thereof, such as IgG CH2 and CH3 domains), as found in a small modular immunopharmaceutical (SMIP™) protein or a reverse SMIP molecule (referred to herein as a PIMS molecule), or the like. The present disclosure also provides fusion proteins having multiple binding domains that are mono-specific (and multivalent) or multi-specific. For example, mono-specific, multivalent fusion proteins can have at least two binding domains that are specific for the same target, such as an IL6xR complex as described herein. Exemplary multi-specific fusion proteins having a binding domain specific for an IL6xR as described herein may contain at least one additional binding region or domain that is specific for a target other than IL6xR, such as TNFα or TGFβ.

Furthermore, this disclosure provides nucleic acid molecules that encode such binding polypeptides or fusion proteins, as well as vectors and host cells for recombinantly producing such molecules, and compositions and methods for using the binding polypeptides or fusion proteins of this disclosure in a variety of diagnostic and therapeutic applications, including the treatment as well as the amelioration of at least one symptom of a disease or disorder, such as a hyperproliferative (e.g., myeloma), autoimmune, or inflammatory disease (e.g., rheumatoid arthritis). The compounds and compositions of this disclosure are also useful as research tools for in vitro and cell-based assays to study the biological activities of IL6 and related molecules.

Prior to setting forth this disclosure in more detail, it may be helpful to an understanding thereof to provide definitions of certain terms to be used herein. Additional definitions are set forth throughout this disclosure.

In the present description, any concentration range, percentage range, ratio range, or integer range is to be understood to include the value of any integer within the recited range and, when appropriate, fractions thereof (such as one tenth and one hundredth of an integer), unless otherwise indicated. Also, any number range recited herein relating to any physical feature, such as polymer subunits, size or thickness, are to be understood to include any integer within the recited range, unless otherwise indicated. As used herein, "about" or "consisting essentially of" mean±20% of the indicated range, value, or structure, unless otherwise indicated. As used herein, the terms "include" and "comprise" are used synonymously. It should be understood that the terms "a" and "an" as used herein refer to "one or more" of the enumerated components. The use of the alternative (e.g., "or") should be understood to mean either one, both, or any combination thereof of the alternatives. In addition, it should be understood that the individual compounds, or groups of compounds, derived from the various combinations of the structures and substituents described herein, are disclosed by the present application to the same extent as if each compound or group of compounds was set forth individually. Thus, selection of particular structures or particular substituents is within the scope of the present invention.

A "binding domain" or "binding region" according to the present disclosure may be, for example, any protein, polypeptide, oligopeptide, or peptide that possesses the ability to specifically recognize and bind to a biological molecule (e.g., IL6, IL6R) or complex of more than one of the same or different molecule or assembly or aggregate, whether stable or transient (e.g., IL6xR complex). Such biological molecules include proteins, polypeptides, oligopeptides, peptides, amino acids, or derivatives thereof; lipids, fatty acids, or derivatives thereof; carbohydrates, saccharides, or derivatives thereof; nucleotides, nucleosides, peptide nucleic acids, nucleic acid molecules, or derivatives thereof; glycoproteins, glycopeptides, glycolipids, lipoproteins, proteolipids, or derivatives thereof; other biological molecules that may be present in, for example, a biological sample; or any combination thereof. A binding region includes any naturally occurring, synthetic, semi-synthetic, or recombinantly produced binding partner for a biological molecule or other target of interest. A variety of assays are known for identifying binding domains of the present disclosure that specifically bind with a particular target, including Western blot, ELISA, or Biacore® analysis.

Terms understood by those in the art as referring to antibody technology are each given the meaning acquired in the art, unless expressly defined herein. For example, the terms "$V_L$" and "$V_H$" refer to the variable binding region derived from an antibody light and heavy chain, respectively. The variable binding regions are made up of discrete, well-defined sub-regions known as "complementarity determining regions" (CDRs) and "framework regions" (FRs). The terms "$C_L$" and "$C_H$" refer to an "immunoglobulin constant region," i.e., a constant region derived from an antibody light or heavy chain, respectively, with the latter region understood to be further divisible into $C_{H1}$, $C_{H2}$, $C_{H3}$ and $C_{H4}$ constant region domains, depending on the antibody isotype (IgA, IgD, IgE, IgG, IgM) from which the region was derived. A portion of the constant region domains makes up the Fc region (the "fragment crystallizable" region), which contains domains responsible for the effector functions of an immunoglobulin, such as ADCC (antibody-dependent cell-mediated cytotoxicity), ADCP (antibody-dependent cell-mediated phagocytosis), CDC (complement-dependent cytotoxicity) and complement fixation, binding to Fc receptors, greater half-life in vivo relative to a polypeptide lacking an Fc region, protein A binding, and perhaps even placental transfer (see Capon et al. (1989) Nature, 337:525). Further, a polypeptide containing an Fc region allows for dimerization or multimerization of the polypeptide. A "hinge region," also referred to herein as a "linker," is an amino acid sequence interposed between and connecting the variable binding and constant regions of a single chain of an antibody, which is known in the art as providing flexibility in the form of a hinge to antibodies or antibody-like molecules.

The domain structure of immunoglobulins is amenable to engineering, in that the antigen binding domains and the domains conferring effector functions may be exchanged between immunoglobulin classes and subclasses. Immunoglobulin structure and function are reviewed, for example, in Harlow et al., Eds., *Antibodies: A Laboratory Manual*, Chapter 14 (Cold Spring Harbor Laboratory, Cold Spring Harbor, 1988). An extensive introduction as well as detailed information about all aspects of recombinant antibody technology can be found in the textbook *Recombinant Antibodies* (John Wiley & Sons, NY, 1999). A comprehensive collection of detailed antibody engineering lab protocols can be found in R. Kontermann and S. Dübel, Eds., *The Antibody Engineering Lab Manual* (Springer Verlag, Heidelberg/N.Y., 2000).

"Derivative" as used herein refers to a chemically or biologically modified version of a compound that is structurally similar to a parent compound and (actually or theoretically) derivable from that parent compound. Generally, a "derivative" differs from an "analogue" in that a parent compound may be the starting material to generate a "derivative," whereas the parent compound may not necessarily be used as the starting material to generate an "analogue." A derivative may have different chemical or physical properties to the parent compound. For example, a derivative may be more hydrophilic or it may have altered reactivity (e.g., a CDR having an amino acid change that alters its affinity for a target) as compared to the parent compound.

The term "biological sample" includes a blood sample, biopsy specimen, tissue explant, organ culture, biological fluid or any other tissue, cell or other preparation from a subject or a biological source. A subject or biological source may, for example, be a human or non-human animal, a primary cell culture or culture adapted cell line including genetically engineered cell lines that may contain chromosomally integrated or episomal recombinant nucleic acid sequences, somatic cell hybrid cell lines, immortalized or immortalizable cell lines, differentiated or differentiatable cell lines, transformed cell lines, or the like. In further embodiments of this disclosure, a subject or biological source may be suspected of having or being at risk for having a disease, disorder or condition, including a malignant disease, disorder or condition or a B cell disorder. In certain embodiments, a subject or biological source may be suspected of having or being at risk for having, a hyperproliferative, inflammatory, or autoimmune disease, and in certain other embodiments of this disclosure the subject or biological source may be known to be free of a risk or presence of such disease, disorder, or condition.

IL6 Antagonists

As noted above, the present disclosure provides polypeptides containing a binding region or domain specific for an IL6xR complex that has one or more of the following properties: (1) greater affinity for an IL6xR complex than for either IL6 or IL6Rα alone, (2) competes with membrane or soluble gp130 for binding with a sIL6xR complex, (3) preferentially inhibits IL6 trans-signaling over IL6 cis-signaling, or (4) does not inhibit signaling of gp130 family cytokines other than IL6. In certain embodiments, a binding domain specific for an IL6xR complex according to this disclosure has the following properties: (1) greater affinity for an IL6xR complex than for either IL6 or IL6Rα alone, (2) competes with membrane gp130 for binding with a sIL6xR complex, (3) preferentially inhibits IL6 trans-signaling over IL6 cis-signaling, and (4) does not inhibit signaling of gp130 family cytokines other than IL6. For example, a binding region or domain specific for an IL6xR may be an immunoglobulin variable binding domain or derivative thereof, such as an antibody, Fab, scFv, or the like. In the context of this disclosure, it should be understood that a binding region or domain specific for an IL6xR is not gp130 as described herein.

As used herein, "IL6xR complex" or "IL6xR" refers to a complex of an IL6 with an IL6 receptor, wherein the IL6 receptor (also known as, for example, IL6Rα, IL6RA, IL6R1, and CD126) is either a membrane protein (referred to herein as mIL6R or mIL6Rα) or a soluble form (referred to herein as sIL6R or sIL6Rα). The term "IL6R" encompasses both mIL6Rα and sIL6Rα. In one embodiment, IL6xR comprises a complex of IL6 and sIL6Rα. In certain embodiments, the IL6xR complex is held together via one or more covalent bonds. For example, the carboxy terminus of an IL6R can be fused to the amino-terminus of an IL6 via a peptide linker, to provide a complex known as Hyper-IL6 (see, e.g., Fischer et al. (1997) Nat. Biotechnol. 15:142). A Hyper-IL6 linker can be comprised of a cross-linking compound, a one to 50 amino acid sequence, or a combination thereof. A Hyper-IL6 may further include a dimerization domain, such as an immunoglobulin Fc domain or an immunoglobulin constant domain sub-region. In certain embodiments, the IL6xR complex is held together via non-covalent interactions, such as by hydrogen bonding, electrostatic interactions, Van der Waal's forces, salt bridges, hydrophobic interactions, or the like, or any combination thereof. For example, an IL6 and IL6R can naturally associate non-covalently (e.g., as found in nature, or as synthetic or recombinant proteins) or each can be fused to a dimerization domain, such as an immunoglobulin Fc domain, to further enhance complex stability.

As used herein, "gp130" refers to a signal transduction protein that binds to an IL6xR complex. The gp130 protein can be in a membrane (mgp130), soluble (sgp130), or any other functional form. Exemplary gp130 proteins have a sequence as set forth in GenBank Accession No. NP_002175.2 or any soluble or derivative form thereof (see, e.g., Narazaki et al. (1993) Blood 82:1120 or Diamant et al. (1997) FEBS Lett. 412:379). By way of illustration and not wishing to be bound by theory, an mgp130 protein can bind to either an IL6/mILR or an IL6/sILR complex, whereas a sgp130 primarily binds with an IL6/sILR complex (see Scheller et al. (2006) Scand. J. Immunol. 63:321). Thus, certain embodiments of binding domains, or fusion proteins thereof, of the instant disclosure can inhibit IL6xR complex trans-signaling by binding with higher affinity to IL6xR than to either IL6 or IL6Rα alone and by competing with sIL6xR complex binding to gp130, preferably mgp130, or by augmenting or enhancing sgp130 binding with sIL6xR complex. A binding domain of the instant disclosure "competes" with gp130 binding to a sIL6xR when (1) a binding domain or fusion protein thereof prevents gp130 from binding a sIL6xR and the binding domain binds sIL6xR with equal or higher affinity as compared to the binding of gp130 with sIL6xR, or (2) a binding domain or fusion protein thereof enhances, augments, or promotes sgp130 binding to sIL6xR complex, thereby reducing the amount of time sIL6xR complex is available for binding with mgp130.

Binding domains and fusion proteins thereof of this disclosure can be "immunospecific" or capable of binding to a desired degree, including "specifically or selectively binding" a target while not significantly binding other components present in a test sample, if they bind a target molecule with an affinity or $K_a$ (i.e., an equilibrium association constant of a particular binding interaction with units of 1/M) of, for example, greater than or equal to about $10^5 M^{-1}$, $10^6 M^{-1}$, $10^7 M^{-1}$, $10^8 M^{-1}$, $10^9 M^{-1}$, $10^{10} M^{-1}$, $10^{11} M^{-1}$, $10^{12} M^{-1}$, or $10^{13} M^{-1}$. "High affinity" binding domains refers to those binding domains with a $K_a$ of at least $10^7 M^{-1}$, at least $10^8 M^{-1}$, at least $10^9 M^{-1}$, at least $10^{10} M^{-1}$, at least $10^{11} M^{-1}$, at least $10^{12} M^{-1}$, at least $10^{13} M^{-1}$, or greater. Alternatively, affinity may be defined as an equilibrium dissociation constant ($K_d$) of a particular binding interaction with units of M (e.g., $10^{-5}$ M to $10^{-13}$ M). Affinities of binding domain polypeptides and fusion proteins according to the present disclosure can be readily determined using conventional techniques (see, e.g., Scatchard et al. (1949) Ann. N.Y. Acad. Sci. 51:660; and U.S. Pat. Nos. 5,283,173; 5,468,614, Biacore® analysis, or the equivalent).

In one aspect, an IL6 antagonist binding domain of this disclosure has an affinity for the sIL6xR complex that is at least 2-fold to 1000-fold greater than for either IL6 or IL6Rα alone. By binding to the sIL6xR complex, a binding domain of this disclosure preferentially inhibits IL6 trans-signaling. In certain embodiments, the affinity of a binding domain for the sIL6xR complex is about the same as the affinity of gp130 for sIL6xR complex—with "about the same" meaning equal or up to about 2-fold higher affinity. In certain embodiments, the affinity of the binding domain for the sIL6xR complex is higher than at least 2-fold, at least 3-fold, at least 4-fold, at least 5-fold, at least 6-fold, at least 7-fold, at least 8-fold, at least 9-fold, at least 10-fold, at least 15-fold, at least 20-fold, at least 25-fold, at least 50-fold, at least 100-fold, at least 1000-fold, or greater than the affinity of gp130 for sIL6xR complex. For example, if the affinity of gp130 for a sIL6xR complex is about 2 nM (see, e.g., Gaillard et al. (1999) Eur. Cytokine Netw. 10:337), then a binding domain having at least a 10-fold higher affinity for the sIL6xR complex would have a dissociation constant ($K_d$) of about 0.2 nM or less.

In further embodiments, an IL6 antagonist binding domain of this disclosure comprises a polypeptide sequence that (a) binds to a sIL6xR complex with an affinity at least 2-fold to 1000-fold higher than either IL6 or IL6Rα alone and (b) competes with gp130 for binding to sIL6xR complex or enhances gp130 binding with sIL6xR complex. In further embodiments, a polypeptide binding domain of this disclosure that binds to a sIL6xR complex with an affinity at least 2-fold to 1000-fold higher than for either IL6 or IL6Rα alone may also (i) more significantly or preferentially inhibit IL6 trans-signaling over IL6 cis-signaling, (ii) not inhibit signaling of gp130 cytokine family members other than IL6, (iii) preferentially inhibit IL6 trans-signaling over IL6 cis-signaling and not detectably inhibit signaling of gp130 family cytokines other than IL6, (iv) may have two or more of these properties, or (v) may have all of these properties.

In certain embodiments, a polypeptide IL6 antagonist binding domain of this disclosure binds to a sIL6xR complex with an affinity at least 2-fold to 1000-fold higher than for either IL6 or IL6Rα alone and more significantly or preferentially inhibits IL6 trans-signaling over IL6 cis-signaling. To "preferentially inhibit IL6 trans-signaling over IL6 cis-signaling" refers to altering trans-signaling to an extent that sIL6xR activity is measurably decreased while the decrease in IL6 cis-signaling is not substantially altered (i.e., meaning inhibition is minimal, non-existent, or not measurable). For example, a biomarker for sIL6xR activity (e.g., acute phase expression of antichymotrypsin (ACT) in HepG2 cells) can be measured to detect trans-signaling inhibition. A representative assay is described by Jostock et al. (Eur. J. Biochem., 2001)—briefly, HepG2 cells can be stimulated to overexpress ACT in the presence of sIL6xR (trans-signaling) or IL6 (cis-signaling), but adding spg130 will inhibit the overexpression of ACT induced by sIL6xR while not substantially affecting IL6 induced expression. Similarly, a polypeptide binding domain of this disclosure that preferentially inhibits IL6 trans-signaling over IL6 cis-signaling will inhibit the overexpression of ACT induced by sIL6xR (i.e., inhibit trans-signaling) while not substantially affecting IL6 induced expression (i.e., not measurably decrease cis-signaling). This and other assays known in the art can be used to measure preferential inhibition of IL6 trans-signaling over IL6 cis-signaling (see, e.g., other biomarkers described in Sporri et al. (1999) Int. Immunol. 11:1053; Mihara et al. (1995) Br. J. Rheum. 34:321; Chen et al. (2004) Immun. 20:59).

In further embodiments, signaling by gp130 family cytokines other than IL6 is substantially not inhibited by binding domain polypeptides or fusion proteins thereof of this disclosure. For example, trans-signaling by an IL6xR complex via gp130 will be inhibited, but signaling by one or more other gp130 family cytokines will be minimally or unaffected, such as signaling via leukemia inhibitory factor (LIF), ciliary neurotrophic factor (CNTF), neuropoietin (NP), cardiotropin like cytokine (CLC), oncostatin M (OSM), IL-27, IL-31, cardiotrophin-1 (CT-1), or any combination thereof.

Additionally, the interaction of a binding domain with a target molecule can be provided as a measure of the kinetic association or dissociation of that interaction. The kinetic association ($k_a$), also referred to herein as $k_{ON}$, is a measure of the rate at which binding interaction will occur. In one embodiment, the $k_{ON}$ can be a measure of the likelihood of an unbound binding domain binding to a target molecule given the average time an unbound molecule is in a cell surface area in which it can be bound and given the concentration of unbound molecules on the cell surface in this area. The $k_a$ ($k_{ON}$) has units of 1/M·sec. In certain embodiments, a $k_{ON}$ value can be greater than about $10^3$/M·sec, about $10^4$/M·sec, about $10^5$/M·sec, about $10^6$/M·sec, about $10^7$/M·sec, about $10^8$/M·sec, about $10^9$/M·sec, about $10^{10}$/M·sec, or greater. In the case where the binding domain is a scFv, $k_{ON}$ can range from less than about $10^4$/M·sec to about $10^7$/M·sec (Ulrik et al. (2000) Cancer Res. 60:6434; Xavier and Willson (1998) Biophys. J. 74:2036). The $k_{ON}$ for a binding domain can be measured using methods known in the art, such as surface plasmon resonance (Leonard et al. (2007) J. Immunol. Methods 323:172).

The kinetic dissociation ($k_d$), also referred to herein as $k_{OFF}$, is a measure of the rate of complex dissociation and, thus, the 'dwell time' of the target molecule bound by a polypeptide binding domain of this disclosure. The $k_d$ ($k_{OFF}$) has units of 1/sec. It will be appreciated by those skilled in the art that the preferred in vivo half-life of a binding domain of this disclosure is on the order of days or weeks, but while the binding domain concentration may be low, the target may be plentiful as both IL6 and sIL6 production can be quite elevated in disease states (see, e.g., Lu et al. (1993) Cytokine 5:578). Thus, in certain embodiments, a binding domain of this disclosure has a $k_{OFF}$ of about $10^{-5}$/sec (e.g., about a day) or less. In certain embodiments, the $k_{OFF}$ can range from about $10^{-1}$/sec, about $10^{-2}$/sec, about $10^{-3}$/sec, about $10^{-4}$/sec, about $10^{-5}$/sec, about $10^{-6}$/sec, about $10^{-7}$/sec, about $10^{-8}$/sec, about $10^{-9}$/sec, about $10^{-10}$/sec, or less (see Graff et al. (2004) Protein Eng. Des. Sel. 17:293).

Binding domains of this disclosure can be generated as described herein or by a variety of methods known in the art (see, e.g., U.S. Pat. Nos. 6,291,161; 6,291,158). Sources include antibody gene sequences from various species (which can be formatted as antibodies, sFvs, scFvs or Fabs, such as in a phage library), including human, camelid (from camels, dromedaries, or llamas; Hamers-Casterman et al. (1993) Nature, 363:446 and Nguyen et al. (1998) J. Mol. Biol., 275:413), shark (Roux et al. (1998) Proc. Nat'l. Acad. Sci. (USA) 95:11804), fish (Nguyen et al. (2002) Immunogenetics, 54:39), rodent, avian, ovine, sequences that encode random peptide libraries or sequences that encode an engineered diversity of amino acids in loop regions of alternative non-antibody scaffolds, such as fibrinogen domains (see, e.g., Weisel et al. (1985) Science 230:1388), Kunitz domains (see, e.g., U.S. Pat. No. 6,423,498), lipocalin domains (see, e.g., WO 2006/095164), V-like domains (see, e.g., US Patent Application Publication No. 2007/0065431), C-type lectin domains (Zelensky and Gready (2005) FEBS J. 272:6179), mAb² or Fcab™ (see, e.g., PCT Patent Application Publication Nos. WO 2007/098934; WO 2006/072620), or the like. Additionally, traditional strategies for hybridoma development using a synthetic single chain IL6xR complex, such as a human IL6xR complex or Hyper-IL6, as an immunogen in convenient systems (e.g., mice, HuMAb Mouse®, TC Mouse™, KM-Mouse®, llamas, chicken, rats, hamsters, rabbits, etc.) can be used to develop binding domains of this disclosure.

In an illustrative example, binding domains of this disclosure specific for an IL6xR complex were identified in a Fab phage library of fragments (see Hoet et al. (2005) Nature Biotechnol. 23:344) by screening for binding to a synthetic IL6xR complex. The synthetic IL6xR complex used for this screening comprises a structure of N-IL6Rα(frag)-L1-IL6 (frag)-L2-ID-C, wherein N is the amino-terminus and C is the carboxy-terminus, IL6Rα(frag) is a fragment of full length IL6Rα, IL6(frag) is a fragment of IL6, L1 and L2 are linkers, and ID is an intervening or dimerization domain, such as an immunoglobulin Fc domain.

More specifically, an IL6xR (which is a form of Hyper IL6) used to identify the binding domains specific for IL6xR complex has a structure, from amino-terminus to carboxy-terminus, as follows: (a) a central fragment of 212 amino acids from IL6Rα that is missing the first 110 amino acids of the full length protein and a carboxy-terminal portion that will depend on the isoform used (see GenBank Accession No. NP_000556.1, isoform 1 or NP_852004.1, isoform 2) fused to (2) a linker of $G_3S$ that is in turn fused to (3) a 175 amino acid carboxy-terminal fragment of IL6 (i.e., missing the first 27 amino acids of the full length protein; GenBank Accession No. NP_000591.1) that is in turn fused to (4) a linker that is an IgG2A hinge as set forth in SEQ ID NO:589, which is finally fused to a dimerization domain comprised of an immunoglobulin G1 (IgG1) Fc domain. In certain embodiments, the dimerization domain comprised of an IgG1 Fc domain has one or more of the following amino acids mutated (i.e., have a different amino acid at that position): leucine at position 234 (L234), leucine at position 235 (L235), glycine at position 237 (G237), glutamate at position 318 (E318), lysine at position 320 (K320), lysine at position 322 (K322), or any combination thereof (EU numbering). For example, any one of these amino acids can be changed (mutated) to alanine. In a further embodiment, an IgG1 Fc domain has each of L234, L235, G237, E318, K320, and K322 (according to EU numbering) mutated to an alanine (i.e., L234A, L235A, G237A, E318A, K320A, and K322A, respectively).

In one embodiment, an IL6xR complex used to identify the IL6 antagonist binding domains of this disclosure has an amino acid sequence as set forth in SEQ ID NO:606. In certain embodiments, there are provided polypeptides containing a binding domain specific for an IL6xR complex, wherein the IL6xR is a sIL6xR and has the amino acid sequence as set forth in SEQ ID NO:606. In further embodiments, polypeptides containing a binding domain specific for an IL6xR complex (1) have greater affinity for a sIL6xR complex than for either IL6 or IL6Rα alone, wherein the sIL6xR has an amino acid sequence as set forth in SEQ ID NO:606, (2) compete with membrane or soluble gp130 for binding with an sIL6xR complex having an amino acid sequence as set forth in SEQ ID NO:606, (3) preferentially inhibit IL6 trans-signaling over IL6 cis-signaling, (4) do not inhibit signaling of gp130 family cytokines other than IL6, (5) have any combination thereof of properties (1)-(4), or (6) have all of the properties of (1)-(4). Other exemplary IL6xR complexes that may be used to identify binding domains of the instant disclosure or used as a reference complex to measure any of the aforementioned binding properties are described, for example, in US Patent Publication Nos. 2007/0172458; 2007/0031376; and U.S. Pat. Nos. 7,198,781; 5,919,763.

In some embodiments, IL6 antagonist binding domains of this disclosure comprise $V_H$ and $V_L$ domains specific for an IL6, IL6R, or an IL6xR complex as described herein, and preferably human IL6, human IL6R, or human IL6xR complex. In certain embodiments, the $V_H$ and $V_L$ domains are rodent (e.g., mouse, rat), humanized, or human. Examples of binding domains containing such $V_H$ and $V_L$ domains are set forth in SEQ ID NOS:435-496 and 805-810, and 373-434 and 799-804, respectively. In further embodiments, there are provided polypeptide binding domains specific for an IL6xR complex that bind to the IL6xR with a higher affinity than either IL6 or IL6Rα alone, and compete with mgp130 for binding to the sIL6xR complex or enhance sgp130 binding to sIL6xR, wherein the binding domain comprises a sequence that is at least 90%, at least 91%, at least 92%, at least 93%, at least 94%, at least 95%, at least 96%, at least 97%, at least 98%, at least 99%, at least 99.5%, or at least 100% identical to an amino acid sequence of one or more light chain variable regions ($V_L$) or to one or more heavy chain variable regions ($V_H$), or both, as set forth in SEQ ID NOS:373-434 and 799-804, and 435-496 and 805-810, respectively, wherein each CDR has up to three amino acid changes (i.e., many of the changes will be in the framework region).

In further embodiments, binding domains of this disclosure comprise $V_H$ and $V_L$ domains specific for an IL6, IL6R, or an IL6xR complex as set forth in SEQ ID NOS:435-496 and 805-810, and 373-434 and 799-804, respectively, which are at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5% identical to the amino acid sequence of such $V_H$ domain, $V_L$ domain, or both, wherein each CDR has from zero to three amino acid changes. For example, the amino acid sequence of a $V_H$ domain, $V_L$ domain, or both of this disclosure can be at least 80%, at least 81%, at least 82%, at least 83%, at least 84%, at least 85%, at least 86%, at least 87%, at least 88%, at least 89%, at least 90%, at least 91%, at least 92%, at least 93%, at least 94%, at least 95%, at least 96%, at least 97%, at least 98%, at least 99%, or at least 99.5% identical to the amino acid sequence of $V_H$ domain (e.g., amino acids 512 to 631), $V_L$ domain (e.g., amino acids 649 to 759), or both, respectively, from the exemplary binding domain found in TRU (XT6)-1002 (see SEQ ID NO:608), wherein each CDR has from zero to three amino acid changes.

The terms "identical" or "percent identity," in the context of two or more polypeptide or nucleic acid molecule sequences, means two or more sequences or subsequences that are the same or have a specified percentage of amino acid residues or nucleotides that are the same over a specified region (e.g., 60%, 65%, 70%, 75%, 80%, 85%, 90%, 91%, 92%, 93%, 94%, 95%, 96%, 97%, 98%, 99%, or 100% identity), when compared and aligned for maximum correspondence over a comparison window, or designated region, as measured using methods known in the art, such as a sequence comparison algorithm, by manual alignment, or by visual inspection. For example, preferred algorithms suitable for determining percent sequence identity and sequence similarity are the BLAST and BLAST 2.0 algorithms, which are described in Altschul et al. (1977) Nucleic Acids Res. 25:3389 and Altschul et al. (1990) J. Mol. Biol. 215:403, respectively.

In any of these or other embodiments described herein, the $V_L$ and $V_H$ domains may be arranged in either orientation and may be separated by up to about a thirty amino acid linker as disclosed herein or any other amino acid sequence capable of providing a spacer function compatible with interaction of the two sub-binding domains. In certain embodiments, a linker joining the $V_H$ and $V_L$ domains comprises an amino acid sequence as set forth in SEQ ID NO:497-604 and 823-828, such as Linker 47 (SEQ ID NO:543) or Linker 80 (SEQ ID NO:576). Multi-specific binding domains will have at least two specific sub-binding domains, by analogy to camelid antibody organization, or at least four specific sub-binding domains, by analogy to the more conventional mammalian antibody organization of paired $V_H$ and $V_L$ chains.

In further embodiments, binding domains specific for IL6 antagonists of this disclosure may comprise one (preferably CDR3) or more complementarity determining region ("CDR"), or multiple copies of one or more such CDRs, which have been obtained, derived, or designed from variable regions of an anti-IL6, anti-IL6R, or anti-IL6xR complex scFv or Fab fragment or from heavy or light chain variable regions thereof.

CDRs are defined in various ways in the art, including the Kabat, Chothia, AbM, and contact definitions. The Kabat definition is based on sequence variability and is the most commonly used definition to predict CDR regions (Johnson et al. (2000) Nucleic Acids Res. 28:214). The Chothia definition is based on the location of the structural loop regions (Chothia et al. (1986) J. Mol. Biol. 196:901; Chothia et al. (1989) Nature 342:877). The AbM definition, a compromise between the Kabat and Chothia definitions, is an integral suite of programs for antibody structure modeling produced by the Oxford Molecular Group (Martin et al. (1989) Proc. Nat'l. Acad. Sci. (USA) 86:9268; Rees et al., ABM™, a computer program for modeling variable regions of antibodies, Oxford, UK; Oxford Molecular, Ltd.). An additional definition, known as the contact definition, has been recently introduced (see MacCallum et al. (1996) J. Mol. Biol. 5:732), which is based on an analysis of available complex crystal structures.

By convention, the CDR domains in the heavy chain are referred to as H1, H2, and H3, which are numbered sequentially in order moving from the amino terminus to the carboxy terminus. The CDR-H1 is about ten to 12 residues in length and starts four residues after a Cys according to the Chothia and AbM definitions, or five residues later according to the Kabat definition. The H1 can be followed by a Trp, Trp-Val, Trp-Ile, or Trp-Ala. The length of H1 is approximately ten to 12 residues according to the AbM definition, while the Chothia definition excludes the last four residues. The CDR-H2 starts 15 residues after the end of H1 according to the Kabat and AbM definitions, which is generally preceded by sequence Leu-Glu-Trp-Ile-Gly (but a number of variations are known) and is generally followed by sequence Lys/Arg-Leu/Ile/Val/Phe/Thr/Ala-Thr/Ser/Ile/Ala. According to the Kabat definition, the length of H2 is about 16 to 19 residues, while the AbM definition predicts the length to be nine to 12 residues. The CDR-H3 usually starts 33 residues after the end of H2, is generally preceded by the amino acid sequence Cys-Ala-Arg and followed by the amino acid Gly, and has a length that ranges from three to about 25 residues.

By convention, the CDR regions in the light chain are referred to as L1, L2, and L3, which are numbered sequentially in order moving from the amino terminus to the carboxy terminus. The CDR-L1 generally starts at about residue 24 and generally follows a Cys. The residue after the CDR-L1 is always Trp, which begins one of the following sequences: Trp-Tyr-Gln, Trp-Leu-Gln, Trp-Phe-Gln, or Trp-Tyr-Leu. The length of CDR-L1 is approximately 10 to 17 residues. The CDR-L2 starts about 16 residues after the end of L1 and will generally follow residues Ile-Tyr, Val-Tyr, Ile-Lys, or Ile-Phe. The CDR-L2 is about seven residues in length. The CDR-L3 usually starts 33 residues after the end of L2 and generally follows a Cys, which is generally followed by the sequence Phe-Gly-XXX-Gly and has a length of about seven to 11 residues.

Thus, a binding domain of this disclosure can comprise a single CDR3 from a variable region of an anti-IL6, anti-IL6R, anti-IL6xR, or it can comprise multiple CDRs that can be the same or different. In certain embodiments, IL6 antagonist binding domains of this disclosure comprise $V_H$ and $V_L$ domains comprising framework regions and CDR1, CDR2 and CDR3 regions, wherein (a) the $V_H$ domain comprises the amino acid sequence of a heavy chain CDR3 found in any one of SEQ ID NOS:435-496 and 805-810; or (b) the $V_L$ domain comprises the amino acid sequence of a light chain CDR3 found in any one of SEQ ID NOS:373-434 and 799-804; or (c) the binding domain comprises a $V_H$ amino acid sequence of (a) and a $V_L$ amino acid sequence of (b); or the binding domain comprises a $V_H$ amino acid sequence of (a) and a $V_L$ amino acid sequence of (b) and wherein the $V_H$ and $V_L$ are found in the same reference sequence. In further embodiments, binding domains of this disclosure comprise $V_H$ and $V_L$ domains specific for an IL6, IL6R, or IL6xR complex comprising framework regions and CDR1, CDR2 and CDR3 regions, wherein (a) the $V_H$ domain comprises the amino acid sequence of a heavy chain CDR1, CDR2, and CDR3 found in any one of SEQ ID NOS:435-496 and 805-810; or (b) the $V_L$ domain comprises the amino acid sequence of a light chain CDR1, CDR2, and CDR3 found in any one of SEQ ID NOS: 373-434 and 799-804; or (c) the binding domain comprises a $V_H$ amino acid sequence of (a) and a $V_L$ amino acid sequence of (b); or the binding domain comprises a $V_H$ amino acid sequence of (a) and a $V_L$ amino acid sequence of (b), wherein the $V_H$ and $V_L$ amino acid sequences are from the same reference sequence. Exemplary IL6 antagonist light and heavy chain variable domain CDRs are provided in SEQ ID NOS: 1-186 and 787-792, and 187-372 and 793-798, respectively. Amino acid sequences of IL6 antagonist light chain and heavy chain variable regions are provided in SEQ ID NOS: 373-434 and 799-804, and 435-496 and 805-810, respectively.

In any of the embodiments described herein comprising specific CDRs, an IL6 antagonist binding domain can comprise (i) a $V_H$ domain having an amino acid sequence that is at least 80%, 85%, 90%, 91%, 92%, 93%, 94%, 95%, 96%, 97%, 98%, or 99% identical to the amino acid sequence of a $V_H$ domain found in any one of SEQ ID NOS:435-496 and 805-810, wherein each CDR has from zero to three amino acid changes; or (ii) a $V_L$ domain having an amino acid sequence that is at least 80%, 85%, 90%, 91%, 92%, 93%, 94%, 95%, 96%, 97%, 98%, or 99% identical to the amino acid sequence of a $V_L$ domain found in any one of SEQ ID NOS:373-434 and 799-804, wherein each CDR has from zero to three amino acid changes; or (iii) both a $V_H$ domain of (i) and a $V_L$ domain of (ii); or both a $V_H$ domain of (i) and a $V_L$ domain of (ii) wherein the $V_H$ and $V_L$ are from the same reference sequence.

In certain embodiments, an IL6 antagonist binding domain of this disclosure may be an immunoglobulin-like domain, such as an immunoglobulin scaffold. Immunoglobulin scaffolds contemplated in this disclosure include a scFv, Fab, a domain antibody, or a heavy chain-only antibody. In further embodiments, there are provided anti-IL6 or anti-IL6xR antibodies (e.g., non-human such as mouse or rat, chimeric, humanized, human) or Fab fragments or scFv fragments that have an amino acid sequence that is at least 80%, 85%, 90%, 91%, 92%, 93%, 94%, 95%, 96%, 97%, 98%, 99%, or 100% identical to the amino acid sequence of a $V_H$ and $V_L$ domain set in any one of SEQ ID NOS:435-496 and 805-810, and 373-434 and 799-804, respectively, which may also have one or more of the following properties: (1) greater affinity for an IL6xR complex than for either IL6 or IL6Rα alone, (2) competes with membrane or soluble gp130 for binding with a sIL6xR complex or augments gp130 binding with a sIL6xR complex, (3) preferentially inhibits IL6 trans-signaling over IL6 cis-signaling, or (4) does not inhibit signaling of gp130 family cytokines other than IL6. Such antibodies, Fabs, or scFvs can be used in any of the methods described herein. In certain embodiments, the present disclosure provides polypeptides containing a binding domain that is an IL6 antagonist (i.e., can inhibit IL6 cis- and trans-signaling). In further embodiments, an IL6 antagonist according to this disclosure does not inhibit signaling of gp130 family cytokines other than IL6. Exemplary IL6 antagonists include binding domains specific for an IL6, IL6R, or IL6xR, such as an immunoglobulin variable binding domain or derivative thereof (e.g., an antibody, Fab, scFv, or the like).

Alternatively, binding domains of this disclosure may be part of a scaffold other than an immunoglobulin. Other scaffolds contemplated include an A domain molecule, a fibronectin III domain, an anticalin, an ankyrin-repeat engineered binding molecule, an adnectin, a Kunitz domain, or a protein AZ domain affibody.

As noted herein, variants and derivatives of binding domains, such as light and heavy variable regions and CDRs described herein, are contemplated. In one example, insertion variants are provided wherein one or more amino acid residues supplement a specific binding agent amino acid sequence. Insertions may be located at either or both termini of the protein, or may be positioned within internal regions of the specific binding agent amino acid sequence. Variant products of this disclosure also include mature specific binding agent products, i.e., specific binding agent products wherein leader or signal sequences are removed, and the resulting protein having additional amino terminal residues. The additional amino terminal residues may be derived from another protein, or may include one or more residues that are not identifiable as being derived from a specific protein. Polypeptides with an additional methionine residue at position −1 are contemplated, as are polypeptides of this disclosure with additional methionine and lysine residues at positions −2 and −1. Variants having additional Met, Met-Lys, or Lys residues (or one or more basic residues in general) are particularly useful for enhanced recombinant protein production in bacterial host cells.

As used herein, "amino acids" refer to a natural (those occurring in nature) amino acid, a substituted natural amino acid, a non-natural amino acid, a substituted non-natural amino acid, or any combination thereof. The designations for natural amino acids are herein set forth as either the standard one- or three-letter code. Natural polar amino acids include asparagine (Asp or N) and glutamine (Gln or Q); as well as basic amino acids such as arginine (Arg or R), lysine (Lys or K), histidine (His or H), and derivatives thereof; and acidic amino acids such as aspartic acid (Asp or D) and glutamic acid (Glu or E), and derivatives thereof. Natural hydrophobic amino acids include tryptophan (Trp or W), phenylalanine (Phe or F), isoleucine (Ile or I), leucine (Leu or L), methionine (Met or M), valine (Val or V), and derivatives thereof; as well as other non-polar amino acids such as glycine (Gly or G), alanine (Ala or A), proline (Pro or P), and derivatives thereof. Natural amino acids of intermediate polarity include serine (Ser or S), threonine (Thr or T), tyrosine (Tyr or Y), cysteine (Cys or C), and derivatives thereof. Unless specified otherwise, any amino acid described herein may be in either the D- or L-configuration.

Substitution variants include those fusion proteins wherein one or more amino acid residues in an amino acid sequence are removed and replaced with alternative residues. In some embodiments, the substitutions are conservative in nature; however, this disclosure embraces substitutions that are also non-conservative. Amino acids can be classified according to physical properties and contribution to secondary and tertiary protein structure. A conservative substitution is recognized in the art as a substitution of one amino acid for another amino acid that has similar properties. Exemplary conservative substitutions are set out in Table 1 (see WO 97/09433, page 10, published Mar. 13, 1997), immediately below.

TABLE 1

Conservative Substitutions I

| Side Chain | Characteristic | Amino Acid |
|---|---|---|
| Aliphatic | Non-polar | G, A, P, I, L, V |
| | Polar - uncharged | S, T, M, N, Q |
| | Polar - charged | D, E, K, R |
| Aromatic | | H, F, W, Y |
| Other | | N, Q, D, E |

Alternatively, conservative amino acids can be grouped as described in Lehninger (Biochemistry, Second Edition; Worth Publishers, Inc. NY:NY (1975), pp. 71-77) as set out in Table 2, immediately below.

TABLE 2

Conservative Substitutions II

| Side Chain | Characteristic | Amino Acid |
|---|---|---|
| Non-polar (hydrophobic) | Aliphatic: | A, L, I, V, P |
| | Aromatic | F, W |
| | Sulfur-containing | M |
| | Borderline | G |

TABLE 2-continued

Conservative Substitutions II

| Side Chain | Characteristic | Amino Acid |
| --- | --- | --- |
| Uncharged-polar | Hydroxyl | S, T, Y |
|  | Amides | N, Q |
|  | Sulfhydryl | C |
|  | Borderline | G |
| Positively Charged (Basic) |  | K, R, H |
| Negatively Charged (Acidic) |  | D, E |

Variants or derivatives can also have additional amino acid residues which arise from use of specific expression systems. For example, use of commercially available vectors that express a desired polypeptide as part of a glutathione-S-transferase (GST) fusion product provides the desired polypeptide having an additional glycine residue at position −1 after cleavage of the GST component from the desired polypeptide. Variants which result from expression in other vector systems are also contemplated, including those wherein histidine tags are incorporated into the amino acid sequence, generally at the carboxy and/or amino terminus of the sequence.

Deletion variants are also contemplated wherein one or more amino acid residues in a binding domain of this disclosure are removed. Deletions can be effected at one or both termini of the fusion protein, or from removal of one or more residues within the amino acid sequence.

IL6 Antagonist Binding Domain Fusion Proteins

As set forth herein, a polypeptide binding domain of this disclosure may further be part of a fusion protein in which it is fused to the amino-terminus, carboxy-terminus, or both ends of an intervening domain (e.g., an immunoglobulin constant region or sub-region thereof). Exemplary fusion proteins of this disclosure include SMIP proteins, PIMS proteins, monospecific, multivalent binding domain fusion proteins, multi-specific binding domain fusion proteins, or the like. The one or more binding domains may be joined to an intervening domain via a linker known in the art or as described herein.

As used herein, an "intervening domain" refers to an amino acid sequence that simply functions as a scaffold for one or more binding domains so that the fusion protein will exist primarily (e.g., 50% or more of a population of fusion proteins) or substantially (e.g., 90% or more of a population of fusion proteins) as a single chain polypeptide in a composition. For example, certain intervening domains can have a structural function (e.g., spacing, flexibility, rigidity) or biological function (e.g., an increased half-life in plasma, such as in human blood). Exemplary intervening domains that can increase half-life of the fusion proteins of this disclosure in plasma include albumin, transferrin, a scaffold domain that binds a serum protein, or the like, or fragments thereof.

In preferred embodiments, an intervening domain of a multi-specific fusion protein of this disclosure is a "dimerization domain," which refers to an amino acid sequence capable of promoting the association of at least two single chain polypeptides or proteins via non-covalent or covalent interactions, such as by hydrogen bonding, electrostatic interactions, Van der Waal's forces, disulfide bonds, salt bridges, hydrophobic interactions, or the like, or any combination thereof. Exemplary dimerization domains include immunoglobulin heavy chain constant regions or sub-regions (e.g., $C_{H2}C_{H3}$). It should be understood that a dimerization domain can also promote the formation of higher order multimer complexes, including trimers, tetramers, pentamers, hexamers, septamers, octamers, etc.

A "constant sub-region" is a term defined herein to refer to a preferred peptide, polypeptide, or protein sequence that corresponds to or is derived from part or all of one or more immunoglobulin constant region domains, but not all constant region domains found in a source antibody. In some embodiments, the constant region domains of a fusion protein of this disclosure lack or have minimal effector functions of antibody-dependent cell-mediated cytotoxicity (ADCC), antibody-dependent cell-mediated phagocytosis (ADCP), or complement activation and complement-dependent cytotoxicity (CDC), while retaining the ability to bind some $F_C$ receptors (such as $F_C$Rn binding) and retaining a relatively long half life in vivo. In certain embodiments, a binding domain of this disclosure is fused to a human IgG1 constant region or sub-region, wherein the IgG1 constant region or sub-region has one or more of the following amino acids mutated: leucine at position 234 (L234), leucine at position 235 (L235), glycine at position 237 (G237), glutamate at position 318 (E318), lysine at position 320 (K320), lysine at position 322 (K322), or any combination thereof (EU numbering).

Methods are known in the art for making mutations inside or outside an Fc domain that can alter Fc interactions with Fc receptors (CD16, CD32, CD64, CD89, FcεR1, FcRn) or with the complement component C1q (see, e.g., U.S. Pat. No. 5,624,821; Presta (2002) Curr. Pharma. Biotechnol. 3:237). Particular embodiments of this disclosure include compositions comprising immunoglobulin or fusion proteins that have a constant region or sub-region from human IgG wherein binding to FcRn and protein A are preserved and wherein the Fc domain no longer interacts or minimally interacts with other Fc receptors or C1q. For example, a binding domain of this disclosure can be fused to a human IgG1 constant region or sub-region wherein the asparagine at position 297 (N297 under EU numbering) has been mutated to another amino acid to reduce or eliminate glycosylation at this site and, therefore, abrogate efficient Fc binding to FcγR and C1q. Another exemplary mutation is a P331S, which knocks out C1q binding but does not affect Fc binding.

In further embodiments, an immunoglobulin Fc region may have an altered glycosylation pattern relative to an immunoglobulin referent sequence. For example, any of a variety of genetic techniques may be employed to alter one or more particular amino acid residues that form a glycosylation site (see Co et al. (1993) Mol. Immunol. 30:1361; Jacquemon et al. (2006) J. Thromb. Haemost. 4:1047; Schuster et al. (2005) Cancer Res. 65:7934; Warnock et al. (2005) Biotechnol. Bioeng. 92:831). Alternatively, the host cells in which fusion proteins of this disclosure are produced may be engineered to produce an altered glycosylation pattern. One method known in the art, for example, provides altered glycosylation in the form of bisected, non-fucosylated variants that increase ADCC. The variants result from expression in a host cell containing an oligosaccharide-modifying enzyme. Alternatively, the Potelligent technology of BioWa/Kyowa Hakko is contemplated to reduce the fucose content of glycosylated molecules according to the invention. In one known method, a CHO host cell for recombinant immunoglobulin production is provided that modifies the glycosylation pattern of the immunoglobulin Fc region, through production of GDP-fucose.

Alternatively, chemical techniques are used to alter the glycosylation pattern of fusion proteins of this disclosure. For example, a variety of glycosidase and/or mannosidase inhibitors provide one or more of desired effects of increasing ADCC activity, increasing Fc receptor binding, and altering glycosylation pattern. In certain embodiments, cells expressing a fusion protein of the instant disclosure are grown in a culture medium comprising a carbohydrate modifier at a concentration that increases the ADCC of immunoglycoprotein molecules produced by said host cell, wherein said carbohydrate modifier is at a concentration of less than 800 µM. In a preferred embodiment, the cells expressing these multispecific fusion proteins are grown in a culture medium comprising castanospermine or kifunensine, more preferably castanospermine at a concentration of 100-800 µM, such as 100 µM, 200 µM, 300 µM, 400 µM, 500 µM, 600 µM, 700 µM, or 800 µM. Methods for altering glycosylation with a carbohydrate modifier such as castanospermine are provided in US Patent Application Publication No. 2009/0041756 or PCT Publication No. WO 2008/052030.

In another embodiment, the immunoglobulin Fc region may have amino acid modifications that affect binding to effector cell Fc receptors. These modifications can be made using any technique known in the art, such as the approach disclosed in Presta et al. (2001) *Biochem. Soc. Trans.* 30:487. In another approach, the Xencor XmAb technology is available to engineer constant sub-regions corresponding to Fc domains to enhance cell killing effector function (see Lazar et al. (2006) *Proc. Nat'l. Acad. Sci. (USA)* 103:4005). Using this approach, for example, one can generate constant sub-regions with improved specificity and binding for FCγR, thereby enhancing cell killing effector function.

In still further embodiments, a constant region or sub-region can optionally increase plasma half-life or placental transfer in comparison to a corresponding fusion protein lacking such an intervening domain. In certain embodiments, the extended plasma half-life of a fusion protein of this disclosure is at least two, at least three, at least four, at least five, at least ten, at least 12, at least 18, at least 20, at least 24, at least 30, at least 36, at least 40, at least 48 hours, at least several days, at least a week, at least two weeks, at least several weeks, at least a month, at least two months, at least several months, or more in a human.

A constant sub-region may include part or all of any of the following domains: a $C_{H2}$ domain, a $C_{H3}$ domain (IgA, IgD, IgG, IgE, or IgM), and a $C_{H4}$ domain (IgE or IgM). A constant sub-region as defined herein, therefore, refers to a polypeptide that corresponds to a portion of an immunoglobulin constant region. The constant sub-region may comprise a $C_{H2}$ domain and a $C_{H3}$ domain derived from the same, or different, immunoglobulins, antibody isotypes, or allelic variants (e.g., both are IgG1 or one is IgG1 and the other is IgG2). In some embodiments, the $C_{H3}$ domain is truncated and comprises a carboxy-terminal sequence noted in PCT Publication No. WO 2007/146968 as SEQ ID NOS:366-371, which sequences are hereby incorporated by reference. In certain embodiments, a constant sub-region comprises a $C_{H2}$ domain and $C_{H3}$ domain, which may optionally have an amino-terminal linker, a carboxy-terminal linker, or a linker at both ends.

A "linker" is a peptide that joins or links other peptides or polypeptides, such as a linker of about 2 to about 150 amino acids. In fusion proteins of this disclosure, a linker can join an intervening domain (e.g, an immunoglobulin-derived constant sub-region) to a binding domain or a linker can join two variable regions of a binding domain. For example, a linker can be an amino acid sequence obtained, derived, or designed from an antibody hinge region sequence, a sequence linking a binding domain to a receptor, or a sequence linking a binding domain to a cell surface transmembrane region or membrane anchor. In some embodiments, a linker can have at least one cysteine capable of participating in at least one disulfide bond under physiological conditions or other standard peptide conditions (e.g., peptide purification conditions, conditions for peptide storage). In certain embodiments, a linker corresponding or similar to an immunoglobulin hinge peptide retains a cysteine that corresponds to the hinge cysteine disposed toward the amino-terminus of that hinge. In further embodiments, a linker is from an IgG1 hinge and has one cysteine or two cysteines corresponding to hinge cysteines. In certain embodiments, one or more disulfide bonds are formed as inter-chain disulfide bonds between intervening domains. In other embodiments, fusion proteins of this disclosure can have an intervening domain fused directly to a binding domain (i.e., absent a linker or hinge). In some embodiments, the intervening domain is a dimerization domain.

Additionally, a binding domain may comprise a $V_H$ and a $V_L$ domain, and these variable region domains may be combined by a linker. Exemplary variable region binding domain linkers include those belonging to the $(Gly_nSer)$ family, such as $(Gly_3Ser)_n(Gly_4Ser)_1$, $(Gly_3Ser)_1(Gly_4Ser)_n$, $(Gly_3Ser)_n(Gly_4Ser)_n$, or $(Gly_4Ser)_n$, wherein n is an integer of 1 to 5 (see, e.g., Linkers 22, 29, 46, 89, 90, and 116 corresponding to SEQ ID NOS:518, 525, 542, 585, 586 and 603, respectively). In preferred embodiments, these $(Gly_nSer)$-based linkers are used to link variable domains and are not used to link a binding domain to an intervening domain.

The intervening or dimerization domain of fusion proteins of this disclosure may be connected to one or more distal or terminal binding domains by a peptide linker. In addition to providing a spacing function, a linker can provide flexibility or rigidity suitable for properly orienting the one or more binding domains of a fusion protein, both within the fusion protein and between or among the fusion proteins and their target(s). Further, a linker can support expression of a full-length fusion protein and stability of the purified protein both in vitro and in vivo following administration to a subject in need thereof, such as a human, and is preferably non-immunogenic or poorly immunogenic in those same subjects. In certain embodiments, a linker of a dimerization domain of fusion proteins of this disclosure may comprise part or all of a human immunoglobulin hinge.

Exemplary linkers that can be used to join an intervening domain (e.g., an immunoglobulin-derived constant sub-region) to a binding domain or to join two variable regions of a binding domain are set forth in SEQ ID NOS:497-604 and 823-828.

Linkers contemplated in this disclosure include, for example, peptides derived from any interdomain region of an immunoglobulin superfamily member (e.g., an antibody hinge region) or a stalk region of C-type lectins, a family of type II membrane proteins. These linkers range in length from about two to about 150 amino acids, or about two to about 40 amino acids, or about eight to about 20 amino acids preferably about ten to about 60 amino acids, more preferably about 10 to about 30 amino acids, and most preferably about 15 to about 25 amino acids. For example, Linker 1 (SEQ ID NO:497) is two amino acids in length and Linker 116 (SEQ ID NO:603) is 36 amino acids in length.

Beyond general length considerations, a linker suitable for use in the fusion proteins of this disclosure includes an antibody hinge region selected from an IgG hinge, IgA hinge, IgD hinge, IgE hinge, or variants thereof. In certain embodiments, a linker may be an antibody hinge region (upper and core region) selected from human IgG1, human IgG2, human IgG3, human IgG4, or fragments or variants thereof. As used herein, a linker that is an "immunoglobulin hinge region" refers to the amino acids found between the carboxyl end of CH1 and the amino terminal end of CH2 (for IgG, IgA, and IgD) or the amino terminal end of CH3 (for IgE and IgM). A "wild type immunoglobulin hinge region," as used herein, refers to a naturally occurring amino acid sequence interposed between and connecting the CH1 and CH2 regions (for IgG, IgA, and IgD) or interposed between and connecting the CH2 and CH3 regions (for IgE and IgM) found in the heavy chain of an antibody. In preferred embodiments, the wild type immunoglobulin hinge region sequences are human.

According to crystallographic studies, an IgG hinge domain can be functionally and structurally subdivided into three regions: the upper hinge region, the core or middle hinge region, and the lower hinge region (Shin et al. (1992) *Immunol. Rev.* 130:87). Exemplary upper hinge regions include EPKSCDKTHT (SEQ ID NO:830) as found in IgG1, ERKCCVE (SEQ ID NO:831) as found in IgG2, ELKTPLGDTT HT (SEQ ID NO:832) or EPKSCDTPPP (SEQ ID NO:833) as found in IgG3, and ESKYGPP (SEQ ID NO:834) as found in IgG4. Exemplary middle hinge regions include CPPCP (SEQ ID NO:835) as found in IgG1 and IgG2, CPRCP (SEQ ID NO:836) as found in IgG3, and CPSCP (SEQ ID NO:837) as found in IgG4. While IgG1, IgG2, and IgG4 antibodies each appear to have a single upper and middle hinge, IgG3 has four in tandem—one of ELKTPLGDTT HTCPRCP (SEQ ID NO:838) and three of EPKSCDTPPP CPRCP (SEQ ID NO:839).

IgA and IgD antibodies appear to lack an IgG-like core region, and IgD appears to have two upper hinge regions in tandem (see SEQ ID NOS:840 and 841). Exemplary wild type upper hinge regions found in IgA1 and IgA2 antibodies are set forth in SEQ ID NOS:842 and 843.

IgE and IgM antibodies, in contrast, instead of a typical hinge region have a CH2 region with hinge-like properties. Exemplary wild-type CH2 upper hinge-like sequences of IgE and IgM are set forth in SEQ ID NO:844 (VCSRDFTPPT VKILQSSSDG GGHFPPTIQL LCLVSGYTPG TINITWLEDG QVMDVDLSTA STTQEGELAS TQSELTLSQK HWLSDRTYTC QVTYQGHTFE DSTKKCA) and SEQ ID NO:845 (VIAELPPKVS VFVPPRDGFF GNPRKSKLIC QATGFSPRQI QVSWLREGKQ VGSGVTTDQV QAEAKESGPT TYKVTSTLTI KESDWLGQSM FTCRVDHRGL TFQQNASSMC VP), respectively.

An "altered wild type immunoglobulin hinge region" or "altered immunoglobulin hinge region" refers to (a) a wild type immunoglobulin hinge region with up to 30% amino acid changes (e.g., up to 25%, 20%, 15%, 10%, or 5% amino acid substitutions or deletions), (b) a portion of a wild type immunoglobulin hinge region that is at least 10 amino acids (e.g., at least 12, 13, 14 or 15 amino acids) in length with up to 30% amino acid changes (e.g., up to 25%, 20%, 15%, 10%, or 5% amino acid substitutions or deletions), or (c) a portion of a wild type immunoglobulin hinge region that comprises the core hinge region (which portion may be 4, 5, 6, 7, 8, 9, 10, 11, 12, 13, 14, or 15, or at least 4, 5, 6, 7, 8, 9, 10, 11, 12, 13, 14, or 15 amino acids in length). In certain embodiments, one or more cysteine residues in a wild type immunoglobulin hinge region, such as an IgG1 hinge comprising the upper and core regions, may be substituted by one or more other amino acid residues (e.g., one or more serine residues). An altered immunoglobulin hinge region may alternatively or additionally have a proline residue of a wild type immunoglobulin hinge region, such as an IgG1 hinge comprising the upper and core regions, substituted by another amino acid residue (e.g., a serine residue).

Alternative hinge and linker sequences that can be used as connecting regions may be crafted from portions of cell surface receptors that connect IgV-like or IgC-like domains. Regions between IgV-like domains where the cell surface receptor contains multiple IgV-like domains in tandem and between IgC-like domains where the cell surface receptor contains multiple tandem IgC-like regions could also be used as connecting regions or linker peptides. In certain embodiments, hinge and linker sequences are from 5 to 60 amino acids long, and may be primarily flexible, but may also provide more rigid characteristics, may contain primarily α helical structure with minimal β sheet structure. Preferably, sequences are stable in plasma and serum and are resistant to proteolytic cleavage. In some embodiments, sequences may contain a naturally occurring or added motif such as CPPC that confers the capacity to form a disulfide bond or multiple disulfide bonds to stabilize the C-terminus of the molecule. In other embodiments, sequences may contain one or more glycosylation sites. Examples of hinge and linker sequences include interdomain regions between IgV-like and IgC-like or between IgC-like or IgV-like domains of CD2, CD4, CD22, CD33, CD48, CD58, CD66, CD80, CD86, CD96, CD150, CD166, and CD244. Alternative hinges may also be crafted from disulfide-containing regions of Type II receptors from non-immunoglobulin superfamily members, such as CD69, CD72, and CD161.

In some embodiments, a hinge linker has a single cysteine residue for formation of an interchain disulfide bond. In other embodiments, a linker has two cysteine residues for formation of interchain disulfide bonds. In further embodiments, a hinge linker is derived from an immunoglobulin interdomain region (e.g., an antibody hinge region) or a Type II C-type lectin stalk region (derived from a Type II membrane protein; see, e.g., exemplary lectin stalk region sequences set forth in of PCT Application Publication No. WO 2007/146968, such as SEQ ID NOS:111, 113, 115, 117, 119, 121, 123, 125, 127, 129, 131, 133, 135, 149, 151, 153, 155, 157, 159, 161, 163, 165, 167, 169, 231, 233, 235, 237, 239, 241, 243, 245, 247, 249, 251, 253, 255, 257, 259, 261, 263, 265, 267, 269, 271, 273, 275, 277, 279, 281, 287, 289, 297, 305, 307, 309-311, 313-331, 346, 373-377, 380, or 381 from that publication), which sequences are hereby incorporated by reference.

In one aspect, fusion proteins of this disclosure comprise a binding domain specific for IL6, IL6R, or IL6xR in the form of a SMIP protein. Methods for making SMIP proteins are described herein and are known in the art (see U.S. Patent Publication Nos. 2003/0133939, 2003/0118592, and 2005/0136049). In certain embodiments, a fusion protein has a polypeptide binding domain specific for an IL6xR complex that binds to the IL6xR with a higher affinity than either IL6 or IL6Rα alone, and competes with gp130 for binding to the sIL6xR complex or enhances gp130 binding with sIL6xR, wherein, from amino-terminus to carboxy-terminus, (a) the polypeptide binding domain is fused to a first linker, (b) an immunoglobulin heavy chain CH2 constant region or sub-region polypeptide is fused to a second linker, and (c) an immunoglobulin heavy chain CH3 constant region or sub-region polypeptide is fused to the CH2 constant region or sub-region polypeptide. Alternatively, a SMIP protein structure can be illustrated as follows: N-BD-L1-CH2CH3-C, wherein N is the amino-terminus of the fusion protein, BD is the anti-IL6xR complex binding domain or scFv, L1 is a linker, CH2 and CH3 are immunoglobulin constant heavy regions 2 and 3, and C is the carboxy-terminus of the fusion protein. In some embodiments, the linker is a $(Gly_4Ser)_n$, wherein n is an integer of 1 to 6, such as 46 (SEQ ID NO:542), or the linker is an IgG1, IgA or IgE hinge region, a mutant IgG1 hinge region having zero, one, or two cysteine residues, such as Linker 47 (SEQ ID NO:543), or Linker 80 (SEQ ID NO:576). In some embodiments, the fusion protein will be fused, via linker or not, to a domain other than an immunoglobulin constant region or sub-region so that the fusion protein remains primarily or substantially a single chain polypeptide in a composition.

In further embodiments, a SMIP fusion protein of this disclosure has a binding domain that comprises a light chain variable region containing CDR1, CDR2, and CDR3 sequences that are each at least 80% to 100% identical to at least one light chain variable region CDR1, CDR2, and CDR3 as set forth in any one of SEQ ID NOS:373-434 and 799-804, respectively, wherein each CDR has from zero to three amino acid changes, and comprises a heavy chain variable region containing CDR1, CDR2, and CDR3 sequences that are each at least 80% to 100% identical to at least one heavy chain variable region CDR1, CDR2, and CDR3 as set forth in any one of SEQ ID NOS:435-496 and 805-810, respectively, wherein each CDR has from zero to three amino acid changes. In still further embodiments, a SMIP fusion protein of this disclosure has an amino acid sequence at least 80%, 85%, 90%, 91%, 92%, 93%, 94%, 95%, 96%, 97%, 98%, 99%, or 100% identical to an amino acid sequence set forth in any one of SEQ ID NOS:671-694, with or without a leader peptide sequence.

In still other embodiments, SMIP polypeptides can have a binding region or domain that is an IL6 antagonist, wherein IL6 cis- and trans-signaling is measurably inhibited. In certain embodiments, an IL6 antagonist according to this disclosure does not inhibit signaling of gp130 family cytokines other than IL6.

In further embodiments, fusion proteins of this disclosure comprise an IL6 antagonist binding domain in the form of a PIMS protein wherein the binding domain is disposed at the carboxy-terminus of the fusion protein. Constructs and methods for making PIMS proteins are described in PCT Publication No. WO 2009/023386. In general, a PIMS molecule is a single-chain polypeptide comprising, in amino-terminal to carboxy-terminal orientation, an intervening domain (e.g., an immunoglobulin constant sub-region derived from that includes a CH2 and CH3 domain from the same (preferred) or different animal species, immunoglobulin isotype and/or immunoglobulin sub-class), a linker peptide (e.g., an immunoglobulin hinge region), and a specific binding domain. In some embodiments, a PIMS molecule further contains an amino-terminally disposed immunoglobulin hinge region, and the amino-terminal hinge region may be the same as, or different than, the linker found between the dimerization domain and the binding domain. In some embodiments, an amino-terminally disposed linker contains a naturally occurring or added motif (such as CPPC) to promote the formation of at least one disulfide bond to stabilize the amino-terminus of a multimerized molecule. Thus, exemplary schematic organizations of some PIMS molecules include N-dimerization domain-linker-binding domain-C or N-hinge linker-dimerization domain-linker-binding domain-C. In some embodiments, the fusion protein will have an intervening domain wherein the fusion protein remains primarily or substantially as a single chain polypeptide in a composition or is found primarily or substantially as a dimer in a composition.

In certain embodiments, a fusion protein has a IL6 antagonist polypeptide binding domain that binds an IL6xR complex with a higher affinity than either IL6 or IL6Rα alone, and competes with gp130 for binding to the sIL6xR complex or enhances gp130 binding to sIL6xR complex, wherein, from carboxy-terminus to amino-terminus, (a) the polypeptide binding domain is fused to a first linker, (b) the first linker is fused to an immunoglobulin heavy chain CH3 constant region or sub-region polypeptide, and (c) the CH3 constant region or sub-region polypeptide is fused to an immunoglobulin heavy chain CH2 constant region or sub-region polypeptide, and (d) the CH2 constant region or sub-region polypeptide is fused to a second linker. In further embodiments, a PIMS fusion protein of this disclosure has a binding domain that comprises a light chain variable region containing CDR1, CDR2, and CDR3 sequences that are each at least 80% to 100% identical to at least one light chain variable region CDR1, CDR2, and CDR3 as set forth in any one of SEQ ID NOS:373-434 and 799-804, respectively, wherein each CDR has from zero to three amino acid changes, and comprises a heavy chain variable region containing CDR1, CDR2, and CDR3 sequences that are each at least 80% to 100% identical to at least one heavy chain variable region CDR1, CDR2, and CDR3 as set forth in any one of SEQ ID NOS:435-496 and 805-810, respectively, wherein each CDR has from zero to three amino acid changes.

In other aspects, fusion proteins of this disclosure comprise a binding domain specific for IL6 or IL6xR in the form of a multi-functional binding protein, such as a SCORPION™ protein. Methods for making SCORPION™ proteins are described herein and are known in the art (see PCT Application Publication No. WO 2007/146968). For other exemplary multi-functional fusion proteins, see, e.g., US Patent Application Publication No. 2006/0051844 and U.S. Pat. No. 7,166,707. In certain embodiments, a mono-specific, multi-valent fusion protein comprises a first and second binding domain, a first and second linker, and a dimerization domain, wherein the dimerization domain is fused at each end via a linker to an immunoglobulin variable region binding domain, or derivative thereof, that are each specific for an IL6xR as described herein. Alternatively, a SCORPION™ protein structure can be illustrated as follows: N-BD1-ID-BD2-C, wherein BD1 is the first binding domain, ID is an intervening domain and BD2 is the second binding domain. In some such constructs, the ID comprises an immunoglobulin constant region or sub-region disposed between the first and second binding domains. In further embodiments, the fusion protein will have an intervening domain wherein the fusion protein remains primarily or substantially as a single chain polypeptide in a composition. In some constructs, the ID is dimerization domain.

In particular embodiments, a fusion protein has at least two polypeptide binding domains specific for an IL6xR complex that bind to the IL6xR with a higher affinity than either IL6 or IL6Rα alone, and compete with gp130 for binding to the sIL6xR complex or enhances gp130 binding to sIL6xR complex, wherein, from amino-terminus to carboxy-terminus, (a) a first polypeptide binding domain is fused to a first linker, (b) the first linker is fused to an immunoglobulin heavy chain CH2 constant region or sub-region polypeptide, (c) the CH2 constant region or sub-region polypeptide is fused to an immunoglobulin heavy chain CH3 constant region or sub-region polypeptide, (d) the CH3 constant region or sub-region polypeptide is fused to a second linker, and (e) the second linker is fused to a second polypeptide binding domain. In still further embodiments, a SCORPION™ fusion protein of this disclosure has at least two binding domains that independently comprise a light chain variable region containing CDR1, CDR2, and CDR3 sequences that are each at least 80% to 100% identical to at least one light chain variable region CDR1, CDR2, and CDR3 as set forth in any one of SEQ ID NOS:373-434 and 799-804, respectively, wherein each CDR has from zero to three amino acid changes, and comprises a heavy chain variable region containing CDR1, CDR2, and CDR3 sequences that are each at least 80% to 100% identical to at least one heavy chain variable region CDR1, CDR2, and CDR3 as set forth in any one of SEQ ID NOS:435-496 and 805-810, respectively, wherein each CDR has from zero to three amino acid changes. In some embodiments, the first linker is a (Gly$_4$Ser)$_n$ linker wherein n is an integer of 1 to 5, such as Linker 46 (SEQ ID NO:542). In other embodiments, the first or second linker is an IgG1, IgA or IgE hinge region, or a mutant IgG1 hinge region having zero, one, or two cysteine residues, such as any linker found in SEQ ID NOS:497-604 and 823-828.

In still another aspect, exemplary multi-specific fusion proteins having an IL6 antagonist binding domain as described herein may contain at least one additional binding region or domain that is not an IL6 antagonist. In certain embodiments, a multi-specific fusion protein comprises a first and second binding domain, a first and second linker, and an intervening domain, wherein one end of the intervening domain is fused via a linker to a first binding domain from an immunoglobulin variable region that is specific for an IL6xR and at the other end fused via a linker to a second binding domain that is a ligand binding ectodomain of a receptor, such as an interleukin receptor ectodomain, a growth factor receptor ectodomain (e.g., TGFR), or a tumor necrosis factor superfamily receptor (TNFSFR) ectodomain. In some embodiments, less than the entire ectodomain is employed. Specifically, domains within the ectodomain that confer ligand binding are employed. It is contemplated, for example, that a TNF-α antagonist domain may be at the amino-terminus and the IL6 antagonist binding domain at the carboxy-terminus of a fusion protein, or the IL6 antagonist binding domain may be at the amino-terminus and the TNF-α antagonist may be at the carboxy-terminus. As set forth herein, the binding domains of this disclosure may be fused to each end of an intervening domain (e.g., an immunoglobulin constant region or sub-region thereof, such as an IgG1 CH2CH3). Furthermore, the two or more binding domains may be each joined to an intervening domain via the same or different linker known in the art or as described herein.

Exemplary structures of such multi-specific fusion proteins, referred to herein as Xceptor molecules, include N-BD-ID-ED-C, N-LD-ID-BD-C, N-ED1-ID-LD2-C, wherein BD is an immunoglobulin-like or immunoglobulin variable region binding domain, ID is an intervening and ED is a ligand binding domain, such as a receptor ectodomain, semaphorin domain, or the like. In some constructs, the ID is dimerization domain. In some constructs, the ID can comprise an immunoglobulin constant region or sub-region disposed between the first and second binding domains. In still further embodiments, the fusion protein will have an intervening domain wherein the fusion protein remains primarily or substantially as a single chain polypeptide in a composition.

In some embodiments, a multi-specific fusion protein of this disclosure has a TNF-α antagonist that comprises a TNFRSF ectodomain or a sub-domain of a TNFRSF ectodomain, such as a cysteine rich domain (CRD) 1, CRD2, CRD3, a 50's TNF binding loop, 90's TNF binding loop, or any combination thereof. For example, a TNF-α antagonist can comprise an ectodomain of TNFRSF1A as set forth in SEQ ID NO:696 (with or without the native leader peptide sequence included in this sequence) or an ectodomain of TNFRSF1B as set forth in SEQ ID NO:695 (with or without the native leader peptide sequence included in this sequence).

In particular embodiments, a fusion protein has (a) a polypeptide binding domain specific for an IL6xR complex that binds to the IL6xR with a higher affinity than either IL6 or IL6Rα alone, and competes with gp130 for binding to the sIL6xR complex or enhances gp130 binding to sIL6xR complex, and (b) a polypeptide binding domain comprising a TNFRSF1B ectodomain, wherein, from amino-terminus to carboxy-terminus or from carboxy-terminus to amino-terminus, (a) an anti-IL6xR binding domain or TNFRSF ectodomain is fused to a first linker, (b) the first linker is fused to an immunoglobulin heavy chain CH2 constant region or sub-region polypeptide, (c) the CH2 constant region or sub-region polypeptide is fused to an immunoglobulin heavy chain CH3 constant region or sub-region polypeptide, (d) the CH3 constant region or sub-region polypeptide is fused to a second linker, and (e) the second linker is fused to an anti-IL6xR binding domain or TNFRSF1B ectodomain. In certain embodiments, the multi-specific Xceptor fusion protein of this disclosure has an IL6xR binding domain that comprises a light chain variable region containing CDR1, CDR2, and CDR3 sequences that are each at least 80% to 100% identical to at least one light chain variable region CDR1, CDR2, and CDR3 as set forth in any one of SEQ ID NOS:373-434 and 799-804, respectively, wherein each CDR has from zero to three amino acid changes, and comprises a heavy chain variable region containing CDR1, CDR2, and CDR3 sequences that are each at least 80% to 100% identical to at least one heavy chain variable region CDR1, CDR2, and CDR3 as set forth in any one of SEQ ID NOS:435-496 and 805-810, respectively, wherein each CDR has from zero to three amino acid changes. In a related embodiment, the TNFRSF1B ectodomain comprises an amino acid sequence as set forth in SEQ ID NO:695 provided the native leader peptide sequence is not included. In still further embodiments, an Xceptor fusion protein of this disclosure has an amino acid sequence at least 80%, 85%, 90%, 91%, 92%, 93%, 94%, 95%, 96%, 97%, 98%, 99%, or 100% identical to a sequence set forth in any one of SEQ ID NOS:607-668, with or without a leader peptide sequence, wherein each CDR has from zero to three amino acid changes.

Generally, such constructs will have a type I receptor ectodomain at the amino-terminus or a type II receptor ectodomain at the carboxy-terminus of a multi-specific fusion protein of this disclosure. An example of a construct having a type I receptor ectodomain is a construct having a TNF receptor superfamily (TNFRSF) ectodomain at the amino-terminus and the IL6xR complex binding domain at the carboxy-terminus. Unexpectedly, a type I receptor ectodomain construct having a TNFRSF ectodomain at the carboxy-terminus also worked (see SEQ ID NOS:669 and 670).

In the case of a polypeptide of this disclosure having multiple binding domains, e.g., Binding Domain-1 (BD1) and Binding Domain-2 (BD2), one of which is for example anti-IL6xR, a low value of $k_{OFF}$ will maximize inhibitory activity and the concentration of a polypeptide or fusion protein of this disclosure bound at full valency, so the dosage range will broaden over forms of polypeptide or fusion protein having BD1 or BD2 alone interacting (see Perelson (1980) Math. Biosci. 49:87). It may also be of interest to select binding domains with high values of $k_{OFF}$. For example, a high $k_{OFF}$ may be desired for a receptor in which a short dwell time in the complex is preferred for invoking the desired signaling phenotype (see Matsui et al., (1994) Proc. Nat'l. Acad. Sci. (USA) 91:12862; Lyons et al., (1996) Immunity 5:53). It will be appreciated by those skilled in the art that $k_{OFF}$ can be independently controlled for BD1 and BD2 for a composition comprising two binding domains, e.g., a SCORPION™ molecule, as described herein. For a further non-limiting example, it may be desirable for one of binding domain to have a very low $k_{OFF}$ and the other binding domain to have a relatively high $k_{OFF}$. This can allow a multispecific binding polypeptide to have a long residence time on the cell surface bound to target molecules corresponding to the low $k_{OFF}$ BD while serially engaging target molecules corresponding to the high $k_{OFF}$ BD. This can have the effect of augmenting signaling when SCORPION™ protein concentrations are low (see Kalergis et al., (2001) Nature Immunol. 2:229). It will be appreciated by those skilled in the art that $k_{OFF}$ can be modified by engineering binding domains or by screening for binding domains with the desired kinetic properties (see Su et al. (2007) J. Immunol. Methods 322:94; Steukers et al. (2006) J. Immunol. Methods 310:126; Jermutus et al. (2001) Proc. Nat'l. Acad. Sci. (USA) 98:75).

To efficiently produce any of the binding domain polypeptides or fusion proteins described herein, a leader peptide is used to facilitate secretion of expressed polypeptides and fusion proteins. Using any of the conventional leader peptides (signal sequences) is expected to direct nascently expressed polypeptides or fusion proteins into a secretory pathway and to result in cleavage of the leader peptide from the mature polypeptide or fusion protein at or near the junction between the leader peptide and the polypeptide or fusion protein. A particular leader peptide will be chosen based on considerations known in the art, such as using sequences encoded by polynucleotides that allow the easy inclusion of restriction endonuclease cleavage sites at the beginning or end of the coding sequence for the leader peptide to facilitate molecular engineering, provided that such introduced sequences specify amino acids that either do not interfere unacceptably with any desired processing of the leader peptide from the nascently expressed protein or do not interfere unacceptably with any desired function of a polypeptide or fusion protein molecule if the leader peptide is not cleaved during maturation of the polypeptides or fusion proteins. Exemplary leader peptides of this disclosure include natural leader sequences or others, such as $H_3N$-MDFQVQIFSFLLISASVIMSRG(X)$_n$—$CO_2H$, wherein X is any amino acid and n is zero to three (SEQ ID NO:785) or $H_3N$-MEAPAQLLFLLLLWLPDTTG-$CO_2H$ (SEQ ID NO:786).

In certain illustrative embodiments, such a protein is glycosylated, the pattern of glycosylation being dependent upon a variety of factors including the host cell in which the protein is expressed (if prepared in recombinant host cells) and the culture conditions.

This disclosure also provides derivatives of the binding domain of this disclosure or of fusion proteins comprising such binding domain. Derivatives include specific binding agent polypeptides bearing modifications other than insertion, deletion, or substitution of amino acid residues. Preferably, the modifications are covalent in nature, and include for example, chemical bonding with polymers, lipids, other organic, and inorganic moieties. Derivatives of this disclosure may be prepared to increase circulating half-life of a specific binding agent polypeptide, or may be designed to improve targeting capacity for the polypeptide to desired cells, tissues, or organs.

In certain embodiments, the in vivo half-life of the binding domain polypeptide or fusion protein thereof of this disclosure can be increased using methods known in the art for increasing the half-life of large molecules. For example, this disclosure embraces fusion proteins that are covalently modified or derivatized to include one or more water-soluble polymer attachments, such as polyethylene glycol, polyoxyethylene glycol, or polypropylene glycol (see, e.g., U.S. Pat. Nos. 4,640,835; 4,496,689; 4,301,144; 4,670,417; 4,791,192; 4,179,337). Still other useful polymers known in the art include monomethoxy-polyethylene glycol, dextran, cellulose, and other carbohydrate-based polymers, poly-(N-vinyl pyrrolidone)-polyethylene glycol, propylene glycol homopolymers, a polypropylene oxide/ethylene oxide co-polymer, polyoxyethylated polyols (e.g., glycerol) and polyvinyl alcohol, as well as mixtures of these polymers. Particularly preferred are polyethylene glycol (PEG)-derivatized proteins. Water-soluble polymers may be bonded at specific positions, for example at the amino terminus of the proteins and polypeptides according to this disclosure, or randomly attached to one or more side chains of the polypeptide. The use of PEG for improving therapeutic capacities is described in U.S. Pat. No. 6,133,426.

Such methods also include creating fusion proteins wherein the binding domain is fused to a protein that conveys a longer half life to the binding domain fusion protein than that of the binding domain alone. Such fusion proteins can include proteins that themselves bind to proteins that have a long half life, e.g., immunoglobulin, immunoglobulin Fc domains, transferrin, streptococcal G protein, or albumin. Such fusions of binding domains to stable plasma proteins are disclosed, e.g., in U.S. Pat. Nos. 5,428,130; 5,116,964.

A particular embodiment of this disclosure is an immunoglobulin or an Fc fusion protein. Such a fusion protein can have a long half-life, e.g., several hours, a day or more, or even a week or more, especially if the Fc domain is capable of interacting with FcRn, the neonatal Fc receptor. The binding site for FcRn in an Fc domain is also the site at which the bacterial proteins A and G bind. The tight binding between these proteins can be used as a means to purify antibodies or fusion proteins of this disclosure by, for example, employing protein A or protein G affinity chromatography during protein purification.

Protein purification techniques are well known to those of skill in the art. These techniques involve, at one level, the crude fractionation of the polypeptide and non-polypeptide fractions. Further purification using chromatographic and electrophoretic techniques to achieve partial or complete purification (or purification to homogeneity) is frequently desired. Analytical methods particularly suited to the preparation of a pure fusion protein are ion-exchange chromatography, exclusion chromatography; polyacrylamide gel electrophoresis; and isoelectric focusing. Particularly efficient methods of purifying peptides are fast protein liquid chromatography and HPLC.

Certain aspects of the present invention concern the purification, and in particular embodiments, the substantial purification, of a polypeptide of this disclosure. The term "purified" as used herein, is intended to refer to a composition, isolatable from other components, wherein the fusion protein is purified to any degree relative to its naturally obtainable state. A purified protein therefore also refers to such protein, isolated from the environment in which it naturally occurs.

Generally, "purified" will refer to a polypeptide composition that has been subjected to fractionation to remove various other components, and which composition substantially retains its expressed biological activity. Where the term "substantially purified" is used, this designation refers to a binding domain protein composition in which the protein forms the major component of the composition, such as constituting about 50%, about 60%, about 70%, about 80%, about 90%, about 95%, about 99% or more of the protein, by weight, in the composition.

Various methods for quantifying the degree of purification are known to those of skill in the art in light of the present disclosure. These include, for example, determining the specific binding activity of an active fraction, or assessing the amount of protein in a fraction by SDS/PAGE analysis. A preferred method for assessing the purity of a protein fraction is to calculate the binding activity of the fraction, to compare it to the binding activity of the initial extract, and to thus calculate the degree of purification, herein assessed by a "-fold purification number." The actual units used to represent the amount of binding activity will, of course, be dependent upon the particular assay technique chosen to follow the purification and whether or not the expressed protein exhibits a detectable binding activity.

Various techniques suitable for use in protein purification are well known to those of skill in the art. These include, for example, precipitation with ammonium sulfate, PEG, antibodies and the like, or by heat denaturation, followed by centrifugation; chromatography steps such as ion exchange, gel filtration, reverse phase, hydroxylapatite and affinity chromatography; isoelectric focusing; gel electrophoresis; and combinations of these and other techniques. As is generally known in the art, the order of conducting various purification steps may be changed, or certain steps may be omitted and still result in a suitable method for the preparation of a substantially purified protein.

Polynucleotides, Expression Vectors, and Host Cells

This disclosure provides polynucleotides (isolated or purified or pure polynucleotides) encoding the fusion proteins of this disclosure, vectors (including cloning vectors and expression vectors) comprising such polynucleotides, and cells (e.g., host cells) transformed or transfected with a polynucleotide or vector according to this disclosure.

In certain embodiments, a polynucleotide (DNA or RNA) encoding a binding domain of this disclosure, or a fusion protein containing one or more such binding domains is contemplated. Expression cassettes encoding SMIP and Xceptor constructs are provided in the examples appended hereto.

The present invention also relates to vectors that include a polynucleotide of this disclosure and, in particular, to recombinant expression constructs. In one embodiment, this disclosure contemplates a vector comprising a polynucleotide encoding a binding domain of this disclosure or a polypeptide comprising such a binding domain, e.g., a SMIP, PIMS, SCORPION, Xceptor or other mono, bi- or multi-functional fusion protein, along with other polynucleotide sequences that cause or facilitate transcription, translation, and processing of such binding domain-encoding sequences.

Appropriate cloning and expression vectors for use with prokaryotic and eukaryotic hosts are described, for example, in Sambrook et al., Molecular Cloning: A Laboratory Manual, Second Edition, Cold Spring Harbor, N.Y., (1989). Exemplary cloning/expression vectors include cloning vectors, shuttle vectors, and expression constructs, that may be based on plasmids, phagemids, phasmids, cosmids, viruses, artificial chromosomes, or any nucleic acid vehicle known in the art suitable for amplification, transfer, and/or expression of a polynucleotide contained therein As used herein, "vector" means a nucleic acid molecule capable of transporting another nucleic acid to which it has been linked. Exemplary vectors include plasmids, yeast artificial chromosomes, and viral genomes. Certain vectors can autonomously replicate in a host cell, while other vectors can be integrated into the genome of a host cell and thereby are replicated with the host genome. In addition, certain vectors are referred to herein as "recombinant expression vectors" (or simply, "expression vectors"), which contain nucleic acid sequences that are operatively linked to an expression control sequence and, therefore, are capable of directing the expression of those sequences.

In certain embodiments, expression constructs are derived from plasmid vectors. Illustrative constructs include modified pNASS vector (Clontech, Palo Alto, Calif.), which has nucleic acid sequences encoding an ampicillin resistance gene, a polyadenylation signal and a T7 promoter site; pDEF38 and pNEF38 (CMC ICOS Biologics, Inc.), which have a CHEF1 promoter; and pD18 (Lonza), which has a CMV promoter. Other suitable mammalian expression vectors are well known (see, e.g., Ausubel et al., 1995; Sambrook et al., supra; see also, e.g., catalogs from Invitrogen, San Diego, Calif.; Novagen, Madison, Wis.; Pharmacia, Piscataway, N.J.). Useful constructs may be prepared that include a dihydrofolate reductase (DHFR)-encoding sequence under suitable regulatory control, for promoting enhanced production levels of the fusion proteins, which levels result from gene amplification following application of an appropriate selection agent (e.g., methotrexate).

Generally, recombinant expression vectors will include origins of replication and selectable markers permitting transformation of the host cell, and a promoter derived from a highly-expressed gene to direct transcription of a downstream structural sequence, as described above. A vector in operable linkage with a polynucleotide according to this disclosure yields a cloning or expression construct. Exemplary cloning/expression constructs contain at least one expression control element, e.g., a promoter, operably linked to a polynucleotide of this disclosure. Additional expression control elements, such as enhancers, factor-specific binding sites, terminators, and ribosome binding sites are also contemplated in the vectors and cloning/expression constructs according to this disclosure. The heterologous structural sequence of the polynucleotide according to this disclosure is assembled in appropriate phase with translation initiation and termination sequences. Thus, for example, the fusion protein-encoding nucleic acids as provided herein may be included in any one of a variety of expression vector constructs as a recombinant expression construct for expressing such a protein in a host cell.

The appropriate DNA sequence(s) may be inserted into a vector, for example, by a variety of procedures. In general, a DNA sequence is inserted into an appropriate restriction endonuclease cleavage site(s) by procedures known in the art. Standard techniques for cloning, DNA isolation, amplification and purification, for enzymatic reactions involving DNA ligase, DNA polymerase, restriction endonucleases and the like, and various separation techniques are contemplated. A number of standard techniques are described, for example, in Ausubel et al. (1993 Current Protocols in Molecular Biology, Greene Publ. Assoc. Inc. & John Wiley & Sons, Inc., Boston, Mass.); Sambrook et al. (1989 Molecular Cloning, Second Ed., Cold Spring Harbor Laboratory, Plainview, N.Y.); Maniatis et al. (1982 Molecular Cloning, Cold Spring Harbor Laboratory, Plainview, N.Y.); Glover (Ed.) (1985 DNA Cloning Vol. I and II, IRL Press, Oxford, UK); Hames and Higgins (Eds.), (1985 Nucleic Acid Hybridization, IRL Press, Oxford, UK); and elsewhere.

The DNA sequence in the expression vector is operatively linked to at least one appropriate expression control sequence (e.g., a constitutive promoter or a regulated promoter) to direct mRNA synthesis. Representative examples of such expression control sequences include promoters of eukaryotic cells or their viruses, as described above. Promoter regions can be selected from any desired gene using CAT (chloramphenicol transferase) vectors or other vectors with selectable markers. Eukaryotic promoters include CMV immediate early, HSV thymidine kinase, early and late SV40, LTRs from retrovirus, and mouse metallothionein-I. Selection of the appropriate vector and promoter is well within the level of ordinary skill in the art, and preparation of certain particularly preferred recombinant expression constructs comprising at least one promoter or regulated promoter operably linked to a nucleic acid encoding a protein or polypeptide according to this disclosure is described herein.

Variants of the polynucleotides of this disclosure are also contemplated. Variant polynucleotides are at least 90%, and preferably 95%, 99%, or 99.9% identical to one of the polynucleotides of defined sequence as described herein, or that hybridizes to one of those polynucleotides of defined sequence under stringent hybridization conditions of 0.015M sodium chloride, 0.0015M sodium citrate at about 65-68° C. or 0.015M sodium chloride, 0.0015M sodium citrate, and 50% formamide at about 42° C. The polynucleotide variants retain the capacity to encode a binding domain or fusion protein thereof having the functionality described herein.

The term "stringent" is used to refer to conditions that are commonly understood in the art as stringent. Hybridization stringency is principally determined by temperature, ionic strength, and the concentration of denaturing agents such as formamide. Examples of stringent conditions for hybridization and washing are 0.015M sodium chloride, 0.0015M sodium citrate at about 65-68° C. or 0.015M sodium chloride, 0.0015M sodium citrate, and 50% formamide at about 42° C. (see Sambrook et al., Molecular Cloning: A Laboratory Manual, 2nd Ed., Cold Spring Harbor Laboratory, Cold Spring Harbor, N.Y. 1989).

More stringent conditions (such as higher temperature, lower ionic strength, higher formamide, or other denaturing agent) may also be used; however, the rate of hybridization will be affected. In instances wherein hybridization of deoxyoligonucleotides is concerned, additional exemplary stringent hybridization conditions include washing in 6×SSC, 0.05% sodium pyrophosphate at 37° C. (for 14-base oligonucleotides), 48° C. (for 17-base oligonucleotides), 55° C. (for 20-base oligonucleotides), and 60° C. (for 23-base oligonucleotides).

A further aspect of this disclosure provides a host cell transformed or transfected with, or otherwise containing, any of the polynucleotides or vector/expression constructs of this disclosure. The polynucleotides or cloning/expression constructs of this disclosure are introduced into suitable cells using any method known in the art, including transformation, transfection and transduction. Host cells include the cells of a subject undergoing ex vivo cell therapy including, for example, ex vivo gene therapy. Eukaryotic host cells contemplated as an aspect of this disclosure when harboring a polynucleotide, vector, or protein according to this disclosure include, in addition to a subject's own cells (e.g., a human patient's own cells), VERO cells, HeLa cells, Chinese hamster ovary (CHO) cell lines (including modified CHO cells capable of modifying the glycosylation pattern of expressed multivalent binding molecules, see US Patent Application Publication No. 2003/0115614), COS cells (such as COS-7), W138, BHK, HepG2, 3T3, RIN, MDCK, A549, PC12, K562, HEK293 cells, HepG2 cells, N cells, 3T3 cells, *Spodoptera frugiperda* cells (e.g., Sf9 cells), *Saccharomyces cerevisiae* cells, and any other eukaryotic cell known in the art to be useful in expressing, and optionally isolating, a protein or peptide according to this disclosure. Also contemplated are prokaryotic cells, including *Escherichia coli, Bacillus subtilis, Salmonella typhimurium*, a Streptomycete, or any prokaryotic cell known in the art to be suitable for expressing, and optionally isolating, a protein or peptide according to this disclosure. In isolating protein or peptide from prokaryotic cells, in particular, it is contemplated that techniques known in the art for extracting protein from inclusion bodies may be used. The selection of an appropriate host is within the scope of those skilled in the art from the teachings herein. Host cells that glycosylate the fusion proteins of this disclosure are contemplated.

The term "recombinant host cell" (or simply "host cell") refers to a cell containing a recombinant expression vector. It should be understood that such terms are intended to refer not only to the particular subject cell but to the progeny of such a cell. Because certain modifications may occur in succeeding generations due to either mutation or environmental influences, such progeny may not, in fact, be identical to the parent cell, but are still included within the scope of the term "host cell" as used herein.

A recombinant host cells can be cultured in a conventional nutrient medium modified as appropriate for activating promoters, selecting transformants, or amplifying particular genes. The culture conditions for particular host cells selected for expression, such as temperature, pH and the like, will be readily apparent to the ordinarily skilled artisan. Various mammalian cell culture systems can also be employed to express recombinant protein. Examples of mammalian expression systems include the COS-7 lines of monkey kidney fibroblasts, described by Gluzman (1981) Cell 23:175, and other cell lines capable of expressing a compatible vector, for example, the C127, 3T3, CHO, HeLa and BHK cell lines. Mammalian expression vectors will comprise an origin of replication, a suitable promoter and, optionally, enhancer, and also any necessary ribosome binding sites, polyadenylation site, splice donor and acceptor sites, transcriptional termination sequences, and 5'-flanking nontranscribed sequences, for example, as described herein regarding the preparation of multivalent binding protein expression constructs. DNA sequences derived from the SV40 splice, and polyadenylation sites may be used to provide the required nontranscribed genetic elements. Introduction of the construct into the host cell can be effected by a variety of methods with which those skilled in the art will be familiar, including calcium phosphate transfection, DEAE-Dextran-mediated transfection, or electroporation (Davis et al. (1986) Basic Methods in Molecular Biology).

In one embodiment, a host cell is transduced by a recombinant viral construct directing the expression of a protein or polypeptide according to this disclosure. The transduced host cell produces viral particles containing expressed protein or polypeptide derived from portions of a host cell membrane incorporated by the viral particles during viral budding.

Compositions and Methods of Use

To treat human or non-human mammals suffering a disease state associated with IL6 trans-signaling, a binding domain of this disclosure is typically made part of a larger protein, as discussed above, and then administered to the subject in an amount that is effective to ameliorate symptoms of the disease state following a course of one or more administrations. Being polypeptides, the proteins of this disclosure can be suspended or dissolved in a pharmaceutically acceptable diluent, optionally including a stabilizer of other pharmaceutically acceptable excipients, which can be used for intravenous administration by injection or infusion, as more fully discussed below.

A pharmaceutically effective dose is that dose required to prevent, inhibit the occurrence of, or treat (alleviate a symptom to some extent, preferably all symptoms of) a disease state. The pharmaceutically effective dose depends on the type of disease, the composition used, the route of administration, the type of subject being treated, the physical characteristics of the specific subject under consideration for treatment, concurrent medication, and other factors that those skilled in the medical arts will recognize. For example, an amount between 0.1 mg/kg and 100 mg/kg body weight (which can be administered as a single dose, daily, weekly, monthly, or at any appropriate interval) of active ingredient may be administered depending on the potency of a binding domain polypeptide or protein fusion of this disclosure.

In certain embodiments, cis-signaling of IL6 is minimally or not inhibited, i.e., any inhibition of cis-signaling is not substantial, meaning that inhibition is non-existent, asymptomatic, or not detectable. The extent of inhibition of IL6 trans-signaling can vary, but in general trans-signaling is altered to an extent that has a positive effect on symptoms of a disease state mediated by or associated with such signaling. In certain embodiments, inhibition of trans-signaling of IL6 by binding domain polypeptides or fusion proteins thereof of this disclosure can retard, stop, or reverse disease progression.

Compositions of this disclosure can be used to treat disease states in human and non-human mammals that are mediated by IL6 signaling. Increased production of IL-6, and thus IL-6 signaling, has been implicated in various disease processes, including Alzheimer's disease, autoimmunity (e.g., rheumatoid arthritis, SLE), inflammation, myocardial infarction, Paget's disease, osteoporosis, solid tumors (e.g., colon cancer, RCC prostatic and bladder cancers), certain neurological cancers, B-cell malignancies (e.g., Castleman's disease, some lymphoma subtypes, chronic lymphocytic leukemia, and, in particular, malignant melanoma). In some instances, IL-6 is implicated in proliferation pathways because it acts with other factors, such as heparin-binding epithelial growth factor and hepatocyte growth factor (see, e.g., Grant et al. (2002) Oncogene 21:460; Badache and Hynes (2001) Cancer Res. 61:383; Wang et al. (2002) Oncogene 21:2584). Blocking IL-6 signaling may thus be of benefit in many pathological situations. IL-6 trans-signaling has been implicated in malignancies, as well as autoimmune or inflammatory conditions, including colon cancer, inflammatory bowel disease, and rheumatoid arthritis. IL6 cis-signaling has been implicated in both malignancies and autoimmune conditions including, in addition to the foregoing, breast cancer. In general, it is thought that trans-signaling may be more associated with autoimmune or inflammatory conditions, and cis-signaling with malignant conditions (see, e.g., Rabe et al. (2008) Blood 111:1021); Sansone et al. (2007) J. Clin Invest. 117: 3988).

Thus, agents comprising the binding domain of this disclosure are useful in treating autoimmune diseases including rheumatoid arthritis, Sjogren's syndrome, multiple sclerosis, systemic lupus erythematosus, Graves' disease, Hashimoto's disease, and Castleman's disease, acute and chronic inflammation, and osteoporosis and other disorders involving loss of bone mass, and cancers, including hormone-independent prostate cancer, B-cell proliferative disorders such as B cell non-Hodgkin's lymphoma, and cancers of the kidney, breast, colon, lung, brain, or other tissues.

In another aspect, compositions of fusion proteins are provided by this disclosure. Pharmaceutical compositions of this disclosure generally comprise one or more type of binding domain or fusion protein in combination with a pharmaceutically acceptable carrier, excipient, or diluent. Such carriers will be nontoxic to recipients at the dosages and concentrations employed. Pharmaceutically acceptable carriers for therapeutic use are well known in the pharmaceutical art, and are described, for example, in Remington's Pharmaceutical Sciences, Mack Publishing Co. (A. R. Gennaro (Ed.) 1985). For example, sterile saline and phosphate buffered saline at physiological pH may be used. Preservatives, stabilizers, dyes and the like may be provided in the pharmaceutical composition. For example, sodium benzoate, sorbic acid, or esters of p-hydroxybenzoic acid may be added as preservatives. Id. at 1449. In addition, antioxidants and suspending agents may be used. Id. The compounds of the present invention may be used in either the free base or salt forms, with both forms being considered as being within the scope of the present invention.

Pharmaceutical compositions may also contain diluents such as buffers, antioxidants such as ascorbic acid, low molecular weight (less than about 10 residues) polypeptides, proteins, amino acids, carbohydrates (e.g., glucose, sucrose or dextrins), chelating agents (e.g., EDTA), glutathione and other stabilizers and excipients. Neutral buffered saline or saline mixed with nonspecific serum albumin are exemplary appropriate diluents. Preferably, product is formulated as a lyophilizate using appropriate excipient solutions (e.g., sucrose) as diluents.

Also contemplated is the administration of multi-specific fusion protein compositions of this disclosure in combination with a second agent. A second agent may be one accepted in the art as a standard treatment for a particular disease state, such as inflammation, autoimmunity, and cancer. Exemplary second agents contemplated include cytokines, growth factors, steroids, NSAIDs, DMARDs, chemotherapeutics, radiotherapeutics, or other active and ancillary agents, or any combination thereof.

"Pharmaceutically acceptable salt" refers to a salt of a binding domain polypeptide or fusion protein of this disclosure that is pharmaceutically acceptable and that possesses the desired pharmacological activity of the parent compound. Such salts include the following: (1) acid addition salts, formed with inorganic acids such as hydrochloric acid, hydrobromic acid, sulfuric acid, nitric acid, phosphoric acid, and the like; or formed with organic acids such as acetic acid, propionic acid, hexanoic acid, cyclopentanepropionic acid, glycolic acid, pyruvic acid, lactic acid, malonic acid, succinic acid, malic acid, maleic acid, fumaric acid, tartaric acid, citric acid, benzoic acid, 3-(4-hydroxybenzoyl)benzoic acid, cinnamic acid, mandelic acid, methanesulfonic acid, ethanesulfonic acid, 1,2-ethane-disulfonic acid, 2-hydroxyethanesulfonic acid, benzenesulfonic acid, 4-chlorobenzenesulfonic acid, 2-naphthalenesulfonic acid, 4-toluenesulfonic acid, camphorsulfonic acid, 4-methylbicyclo[2.2.2]-oct-2-ene-1-carboxylic acid, glucoheptonic acid, 3-phenylpropionic acid, trimethylacetic acid, tertiary butylacetic acid, lauryl sulfuric acid, gluconic acid, glutamic acid, hydroxynaphthoic acid, salicylic acid, stearic acid, muconic acid, and the like; or (2) salts formed when an acidic proton present in the parent compound either is replaced by a metal ion, e.g., an alkali metal ion, an alkaline earth ion, or an aluminum ion; or coordinates with an organic base such as ethanolamine, diethanolamine, triethanolamine, N-methylglucamine, or the like.

In particular illustrative embodiments, a polypeptide or fusion protein of this disclosure is administered intravenously by, for example, bolus injection or infusion. Routes of administration in addition to intravenous include oral, topical, parenteral (e.g., sublingually or buccally), sublingual, rectal, vaginal, and intranasal. The term parenteral as used herein includes subcutaneous injections, intravenous, intramuscular, intrasternal, intracavernous, intrathecal, intrameatal, intraurethral injection or infusion techniques. The pharmaceutical composition is formulated so as to allow the active ingredients contained therein to be bioavailable upon administration of the composition to a patient. Compositions that will be administered to a patient take the form of one or more dosage units, where for example, a tablet may be a single dosage unit, and a container of one or more compounds of this disclosure in aerosol form may hold a plurality of dosage units.

For oral administration, an excipient and/or binder may be present, such as sucrose, kaolin, glycerin, starch dextrans, cyclodextrins, sodium alginate, carboxy methylcellulose, and ethyl cellulose. Sweetening agents, preservatives, dye/colorant, flavor enhancer, or any combination thereof may optionally be present. A coating shell may also optionally be employed In a composition intended to be administered by injection, one or more of a surfactant, preservative, wetting agent, dispersing agent, suspending agent, buffer, stabilizer, isotonic agent, or any combination thereof may optionally be included.

For nucleic acid-based formulations, or for formulations comprising expression products according to this disclosure, about 0.01 µg/kg to about 100 mg/kg body weight will be administered, for example, by the intradermal, subcutaneous, intramuscular, or intravenous route, or by any route known in the art to be suitable under a given set of circumstances. A preferred dosage, for example, is about 1 µg/kg to about 20 mg/kg, with about 5 µg/kg to about 10 mg/kg particularly preferred. It will be evident to those skilled in the art that the number and frequency of administration will be dependent upon the response of the host.

The pharmaceutical compositions of this disclosure may be in any form that allows for administration to a patient, such as, for example, in the form of a solid, liquid, or gas (aerosol). The composition may be in the form of a liquid, e.g., an elixir, syrup, solution, emulsion or suspension. The liquid may be for oral administration or for delivery by injection, as two examples.

A liquid pharmaceutical composition as used herein, whether in the form of a solution, suspension or other like form, may include one or more of the following components: sterile diluents such as water for injection, saline solution, preferably physiological saline, Ringer's solution, isotonic sodium chloride, fixed oils such as synthetic mono or digylcerides that may serve as the solvent or suspending medium, polyethylene glycols, glycerin, propylene glycol or other solvents; antibacterial agents such as benzyl alcohol or methyl paraben; antioxidants such as ascorbic acid or sodium bisulfite; chelating agents such as ethylenediaminetetraacetic acid; buffers such as acetates, citrates or phosphates and agents for the adjustment of tonicity such as sodium, chloride, or dextrose. The parenteral preparation can be enclosed in ampoules, disposable syringes or multiple dose vials made of glass or plastic. Physiological saline is a preferred additive. An injectable pharmaceutical composition is preferably sterile.

It may also be desirable to include other components in the preparation, such as delivery vehicles including aluminum salts, water-in-oil emulsions, biodegradable oil vehicles, oil-in-water emulsions, biodegradable microcapsules, and liposomes. Examples of adjuvants for use in such vehicles include N-acetylmuramyl-L-alanine-D-isoglutamine (MDP), lipopolysaccharides (LPS), glucan, IL-12, GM-CSF, γ-interferon, and IL-15.

While any suitable carrier known to those of ordinary skill in the art may be employed in the pharmaceutical compositions of this disclosure, the type of carrier will vary depending on the mode of administration and whether a sustained release is desired. For parenteral administration, the carrier may comprise water, saline, alcohol, a fat, a wax, a buffer, or any combination thereof. For oral administration, any of the above carriers or a solid carrier, such as mannitol, lactose, starch, magnesium stearate, sodium saccharine, talcum, cellulose, glucose, sucrose, magnesium carbonate, or any combination thereof, may be employed.

This disclosure contemplates a dosage unit comprising a pharmaceutical composition of this disclosure. Such dosage units include, for example, a single-dose or a multi-dose vial or syringe, including a two-compartment vial or syringe, one comprising the pharmaceutical composition of this disclosure in lyophilized form and the other a diluent for reconstitution. A multi-dose dosage unit can also be, e.g., a bag or tube for connection to an intravenous infusion device.

This disclosure also contemplates a kit comprising a pharmaceutical composition of this disclosure in unit dose, or multi-dose, container, e.g., a vial, and a set of instructions for administering the composition to patients suffering a disorder such as a disorder described above.

All U.S. patents, U.S. patent application publications, U.S. patent applications, foreign patents, foreign patent applications, non-patent publications, tables, sequences, webpages, or the like referred to in this specification, are incorporated herein by reference, in their entirety. The following examples are intended to illustrate, but not limit, the invention.

EXAMPLES

SMIP and Xceptor Sequences

Amino acid sequences of exemplary SMIP and Xceptor (SEQ ID NOS:231-292) molecules having an anti-IL6xR binding domain are provided in (SEQ ID NOS:671-694 and 607-668, respectively, with the corresponding nucleotide expression cassettes of the fusion proteins being provide in SEQ ID NOS:761-784 and 697-758, respectively (note the mature proteins will lack the signal peptide sequence found in SEQ ID NOS:671-694 and 607-668).

Xceptors having a TNFRSF1B ectodomain at the amino-terminus and an anti-IL6xR binding domain at the carboxy terminus are referred to herein as TRU(XT6)-1001 to TRU (XT6)-1062. The Xceptors in the reverse orientation—that is, having an anti-IL6xR binding domain at the amino-terminus and a TNFRSF1B ectodomain at the carboxy terminus, are referred to herein as TRU(X6T)-1008 and TRU(X6T)-1019. The SMIP constructs having an anti-IL6xR binding domain are referred to herein as TRU(S6)-1002, TRU(S6)-1004, TRU (S6)-1007, TRU(S6)-1008, TRU(S6)-1011, TRU(S6)-1013, TRU(S6)-1014, TRU(S6)-1018, TRU(S6)-1019, TRU(S6)-1022, TRU(S6)-1024 to TRU(S6)-1026, TRU(S6)-1029, TRU(S6)-1038, TRU(S6)-1040, TRU(S6)-1047, TRU(S6)-1051, TRU(S6)-1052, TRU(S6)-1054, TRU(S6)-1056, and TRU(S6)-1059 to TRU(S6)-1061.

A phage library of Fab binding domains was screened for binding domains specific for an IL6xR complex essentially as described by Hoet et al. (2005) Nature Biotechnol. 23:344. The binding domains were cloned by PCR amplification—briefly, the VL and VH regions from the Fab library clones were amplified using PCR SuperMix (Invitrogen, San Diego, Calif.) and appropriate primers that create the $G_4S$ linker via overlap, with an initial anneal at 56° C. for 9 cycles, then 62° C. for an additional 20 cycles. The PCR products were separated on an agarose gel and purified using a Qiagen (Chatsworth, Calif.) PCR Purification column. The second round sewing reaction involved mixing a molar equivalent of VL and VH products with Expand buffer and water, denatured at 95° C. for 5 sec, then cooled slowly to room temperature. To amplify, a mix of dNTPs were added with Expand enzyme and incubated at 72° C. for 10 sec. The outside primers were added (5'VH and 3'VL) and the mix was cycled 35 times with an anneal at 62° C. and a 45 min extension reaction. The resulting 750 base pair product was gel purified, digested with EcoRI and NotI, and cloned into plasmid pD28 (for more details, see US Patent Application Publication No. 2005/ 0136049 and PCT Application Publication No. WO 2007/ 146968). Binding activity was examined by ELISA as described in Hoet et al. (2005).

Various SMIP and Xceptor fusion proteins described herein were tested for anti-IL6xR activity, anti-TNF activity, or both activities, as described below. Abbreviations used in the following examples include the following terms: PBS-T: PBS, pH 7.2-7.4 and 0.1% Tween®20; Working buffer: PBS-T with 1% BSA; Blocking buffer: PBS-T with 3% BSA.

Example 1

Expression of Fusion Proteins

Expression of certain of the fusion proteins disclosed herein in 293 cells was performed using the FreeStyle™ 293 Expression System (Invitrogen, Carlsbad, Calif.) according to the manufacturer's instructions.

For each 30 ml transfection, $3\times10^7$ cells in 28 ml of FreeStyle™ 293 Expression Medium were used. On the day of transfection, a small aliquot of the cell suspension was transferred to a microcentrifuge tube, and the viability and the amount of cell clumping determined using the trypan blue dye exclusion method. The suspension was vigorously vortexed for 45 seconds to break up cell clumps and total cell counts determined using a Coulter Counter or a hemacytometer. The viability of the cells was over 90%. A shaker flask containing the required cells was placed in a 37° C. incubator on an orbital shaker.

For each transfection sample, lipid-DNA complexes were prepared as follows. 30 μg of plasmid DNA was diluted in Opti-MEM® I to a total volume of 1 ml and mixed gently. 60 μl of 293Fectin™ was diluted in Opti-MEM® I to a total volume of 1 ml, mixed gently, and incubated for 5 minutes at room temperature. After the 5 minute incubation, the diluted DNA was added to the diluted 293Fectin™ to obtain a total volume of 2 ml and mixed gently. The resulting solution was incubated for 20-30 minutes at room temperature to allow DNA-293Fectin™ complexes to form.

While the DNA-293Fectin™ complexes were incubating, the cell suspension was removed from the incubator and the appropriate volume of cell suspension was placed in a sterile, disposable 125 ml Erlenmeyer shaker flasks. Fresh, pre-warmed FreeStyle™ 293 Expression Medium was added up to a total volume of 28 ml for a 30 ml transfection.

After the DNA-293Fectin™ complex incubation was complete, 2 ml of DNA-293Fectin™ complex was added to the shaker flasks. 2 ml of Opti-MEM® I was added to the negative control flask, instead of DNA-293Fectin™ complex. Each flask contained a total volume of 30 ml, with a final cell density of approximately $1\times10^6$ viable cells/ml. The cells were incubated in a 37° C. incubator with a humidified atmosphere of 8% $CO_2$ in air on an orbital shaker rotating at 125 rpm. Cells were harvested at approximately 7 days post-transfection and assayed for recombinant protein expression.

Fusion proteins having an IL6 antagonist binding domain were expressed in 293 cells as described above.

Example 2

Xceptor Binding to IL6 and Hyper IL6 by ELISA

Hyper-IL6 (HIL6 or IL6xR), recombinant human IL6 (rhIL6), and human soluble IL6R binding activity was examined for Xceptors TRU(XT6)-1002, 1019, 1025, 1042, 1058, and TRU(X6T)-1019 (SEQ ID NO:608, 625, 631, 648, 664 and 670, respectively) substantially as follows HIL6 and IL6 Binding Added to each well of a 96-well plate was 100 μl goat anti-human IgG-Fc (Jackson ImmunoResearch, West Grove, Pa.) from a 2 μg/ml solution in PBS, pH 7.2-7.4. The plate was covered, and incubated overnight at 4° C. After washing four times with PBS-T, 250 μl Blocking buffer (PBS-T with 3% BSA or 10% normal goat serum) was added to each well, the plate was covered, and incubated at room temperature for 2 hours (or at 4° C. overnight). After washing the plate three times with PBS-T, added in duplicate wells to the anti-human IgG-Fc coated plate was 100 μl/well Xceptor TNFRSF1B:: anti-HIL6 samples and human gp130-Fc chimera (R&D Systems, Minneapolis, Minn.) serially diluted three-fold in Working buffer starting at 300 ng/ml, the plate was covered, and incubated at room temperature for about 1 to 2 hours. After washing the plate five times with PBS-T, added in duplicate wells was 100 μl/well human Hyper IL-6 or recombinant human IL-6 from a 150 pM solution in Working buffer, the plate was covered, and incubated at room temperature for about 1 to 2 hours. After washing the plate five times with PBS-T, 100 μl/well anti-human IL-6-biotin (R&D Systems) from a 150 ng/ml solution in Working buffer, the plate was covered, and incubated at room temperature for about 1 to 2 hours. After washing the plate five times with PBS-T, 100 μl per well horse radish peroxidase-conjugated streptavidin (Zymed, San Francisco, Calif.) diluted 1:4,000 in Working buffer was added, the plate was covered, and incubated at room temperature for 30 minutes. After washing the plate six times with PBS-T, 100 μl per well 3,3,5,5-tetramentylbenzidine (TMB) substrate solution (Pierce, Rockford, Ill.) was added for about 3 to 5 minutes and then the reaction was stopped with 50 μl Stop buffer (1N $H_2SO_4$) per well. The absorbance of each well was read at 450 nm.

sIL6R Binding

Added to each well of a 96-well plate was 100 μl goat anti-human IgG-Fc (ICN Pharmaceuticals, Costa Mesa, Calif.) from a 2 μg/ml solution in PBS, pH 7.2-7.4. The plates were covered, and incubated overnight at 4° C. After washing four times with PBS-T, 250 μl Blocking buffer (PBS-T with 3% BSA or 10% normal goat serum) was added to each well, the plate was covered, and incubated at room temperature for 2 hours (or at 4° C. overnight). After washing the plate three times with PBS-T, added in duplicate wells to the anti-human IgG-Fc coated plate was 100 μl/well Xceptor TNFRSF1B:: anti-HIL6 samples, positive control anti-human IL-6R (R&D Systems, Minneapolis, Minn.) and negative controls human IgG or human gp130-Fc chimera (R&D Systems), each serially diluted three-fold in Working buffer starting at 300 ng/ml, the plate was covered, and incubated at room temperature for about 1 to 2 hours. After washing the plate five times with PBS-T, added in duplicate wells was 100 μl/well recombinant human sIL-6R (R&D Systems) from a 75 pM solution in Working buffer, the plate was covered, and incubated at room temperature for about 1 to 2 hours. After washing the plate five times with PBS-T, added 100 μl/well anti-human IL-6R-biotin (R&D Systems) from a 100 ng/ml solution in Working buffer, the plate was covered, and incubated at room temperature for about 1 to 2 hours. After washing the plate five times with PBS-T, 100 μl per well horse radish peroxidase-conjugated streptavidin (Zymed, San Francisco, Calif.) diluted 1:4, 000 in Working buffer was added, the plate was covered, and incubated at room temperature for 30 minutes. After washing the plate six times with PBS-T, 100 μl per well 3,3,5,5-tetramentylbenzidine (TMB) substrate solution (Pierce, Rockford, Ill.) was added for about 3 to 5 minutes and then the reaction was stopped with 50 µl Stop buffer (1N H$_2$SO$_4$) per well. The absorbance of each well was read at 450 nm.

Figure 1B:
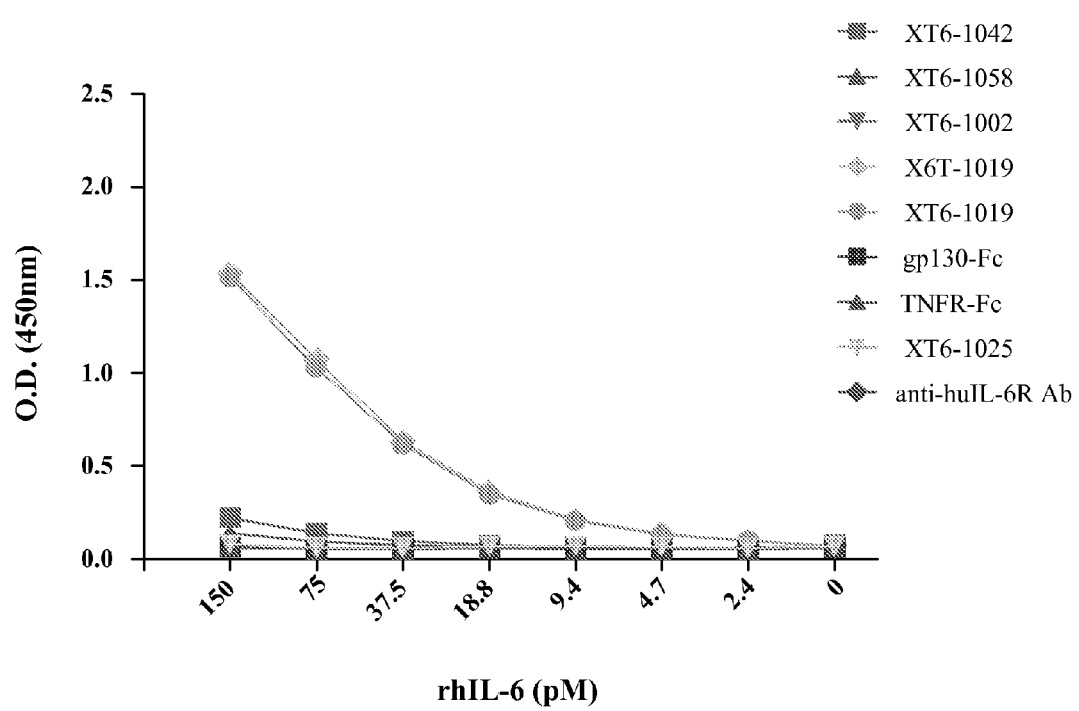
Figure 1C:
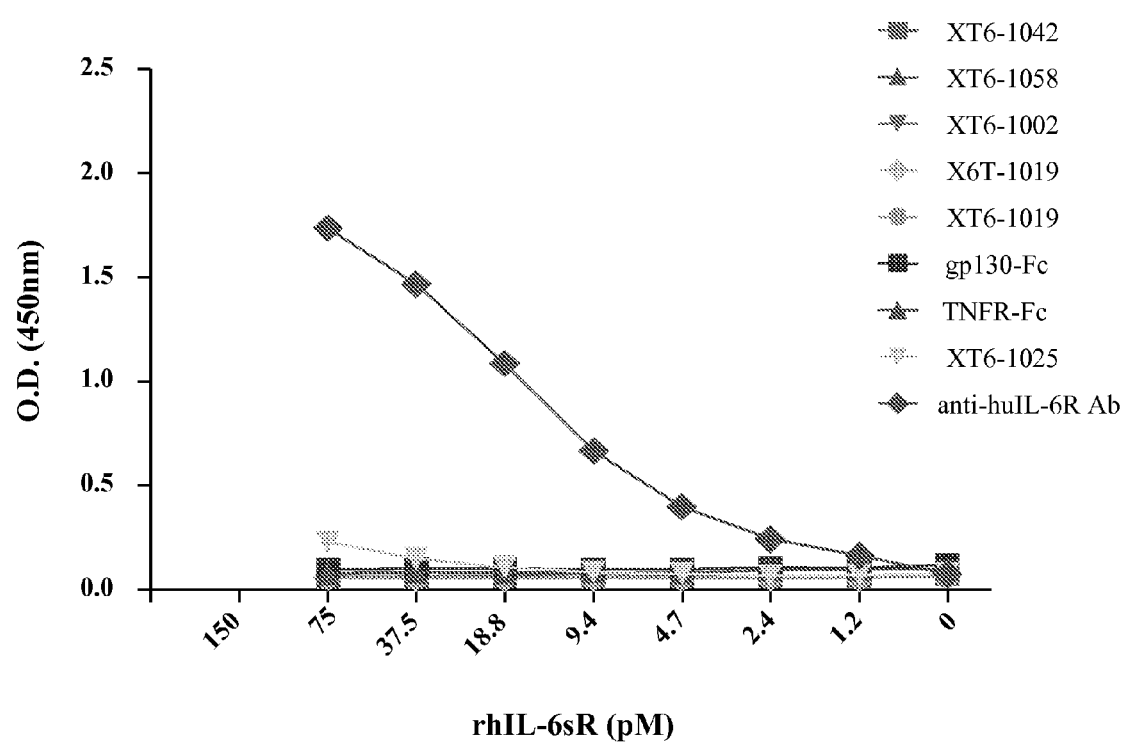

The data in FIGS. 1A and 1B demonstrate that all Xceptor fusion proteins, whether the TNFRSF1B ectodomain was on the amino- or carboxy terminus of the fusion protein molecules, can bind HIL6. Furthermore, these assays show that the Xceptor proteins have specificity for the IL6xR complex because only two of the Xceptors bind rhIL6 (FIG. 1B) and none bind sIL6R (FIG. 1C). In related studies, the xceptor TRU(XT6)-1002 and the SMIP TRU(S6)-1002 were found to cross-react with IL6 from the non-human primate *Mucaca mulatta*.

Example 3

Xceptor Binding to TNF-α by ELISA

TNF-α binding activity was examined for Xceptors TRU (XT6)-1002, 1042, 1058, 1019, and TRU(X6T)-1019 (SEQ ID NO:608, 648, 664, 625 and 670, respectively), substantially as follows.

Added to each well of a 96-well plate was 100 µl goat anti-human IgG-Fc (ICN Pharmaceuticals, Costa Mesa, Calif.) from a 2 µg/ml solution in PBS, pH 7.2-7.4. The plate was covered, and incubated overnight at 4° C. After washing four times with PBS-T, 250 µl Blocking buffer was added to each well, the plate was covered, and incubated at room temperature for 2 hours (or at 4° C. overnight). After washing the plate three times with PBS-T, added in duplicate wells to the anti-human IgG-Fc coated plate was 100 µl/well Xceptor TNFRSF1B::anti-HIL6 samples, positive controls Enbrel® (etanercept) and recombinant human TNFR2 (TNFRSF1B)-Fc chimera (R&D Systems, Minneapolis, Minn.), and negative controls human IgG or human gp130-Fc chimera (R&D Systems), each serially diluted three-fold in Working buffer starting at 300 ng/ml, the plate was covered, and incubated at room temperature for about 1 to 2 hours. After washing the plate five times with PBS-T, added in duplicate wells was 100 µl/well recombinant human TNF-α (R&D Systems) from a 2 ng/ml solution in Working buffer, the plate was covered, and incubated at room temperature for about 1 to 2 hours. After washing the plate five times with PBS-T, added 100 µl/well anti-human TNF-α-biotin (R&D Systems) from a 200 ng/ml solution in Working buffer, the plate was covered, and incubated at room temperature for about 1 to 2 hours. After washing the plate five times with PBS-T, 100 µl per well horse radish peroxidase-conjugated streptavidin (Jackson ImmunoResearch, West Grove, Pa.) diluted 1:1,000 in Working buffer was added, the plate was covered, and incubated at room temperature for 30 minutes. After washing the plate six times with PBS-T, 100 µl per well 3,3,5,5-tetramentylbenzidine (TMB) substrate solution (Pierce, Rockford, Ill.) was added for about 3 to 5 minutes and then the reaction was stopped with 50 µl Stop buffer (1N H$_2$SO$_4$) per well. The absorbance of each well was read at 450 nm.

Figure 2:
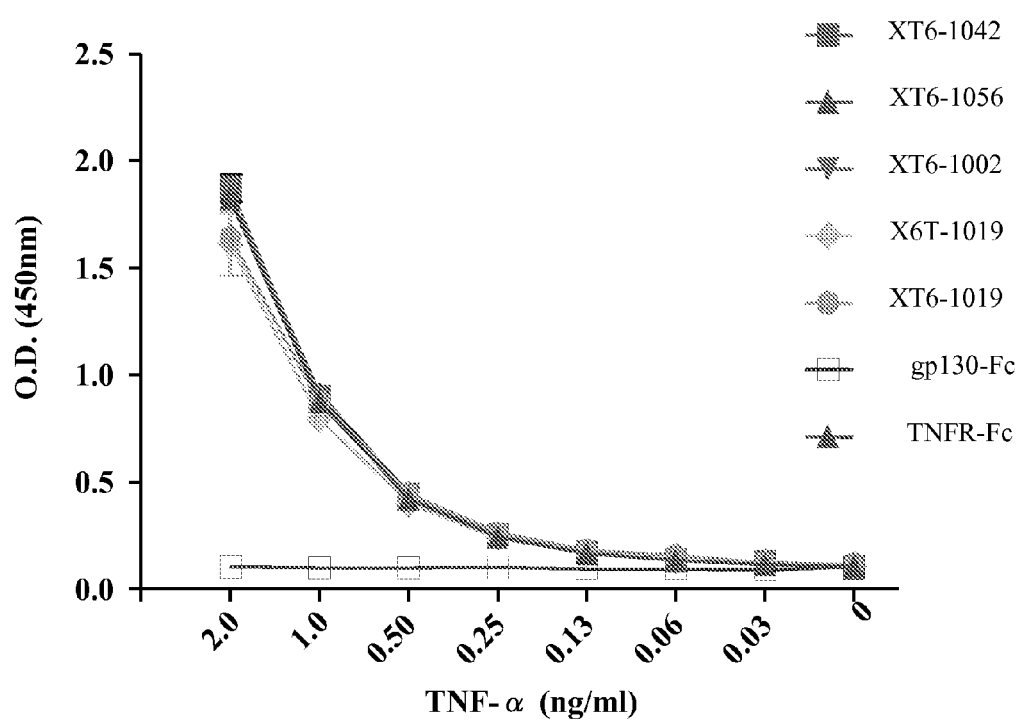
FIG. 2 shows that multi-specific fusion proteins containing a TNFR ectodomain fused to one of various different Hyper-IL6 binding domains bind to TNF-α as measured by ELISA.

The data in FIG. 2 shows that all Xceptor fusion proteins tested can bind TNF-α, whether the TNFRSF1B ectodomain was on the amino- or carboxy terminus of the fusion protein.

Example 4

Xceptor Dual Ligand Binding by ELISA

Concurrent binding to TNF-α and to IL6xR complex was examined for Xceptor fusion protein TRU(XT6)-1006 (SEQ ID NO:612), substantially as follows.

Added to each well of a 96-well plate was 100 µl human HIL-6 solution (5 µg/ml in PBS, pH 7.2-7.4). The plate was covered, and incubated overnight at 4° C. After washing four times with PBS-T, then 250 µl Blocking buffer was added to each well, the plate was covered, and incubated at room temperature for 2 hours (or at 4° C. overnight). After washing the plate three times with PBS-T, added in duplicate wells to the HIL-6 coated plate was 100 µl/well Xceptor TNFRSF1B:: HIL6 samples serially diluted three-fold in Working buffer starting at 300 ng/ml. Negative controls included human gp130-Fc chimera (R&D Systems, Minneapolis, Minn.), Enbrel® (etanercept), and Working buffer only. The plate was covered and incubated at room temperature for 1.5 hours. After washing the plate five times with PBS-T, 100 µl per well recombinant human TNF-α (R&D Systems, Minneapolis, Minn.) to 2 ng/ml in Working buffer was added, the plate was covered, and incubated at room temperature for 1.5 hr. After washing the plate five times with PBS-T, 100 µl per well anti-human TNF-α-biotin (R&D Systems) to 200 ng/ml in Working buffer was added, the plate was covered, and incubated at room temperature for 1.5 hr. After washing the plate five times with PBS-T, 100 µl per well horse radish peroxidase-conjugated streptavidin (Jackson ImmunoResearch, West Grove, Pa.) diluted 1:1000 in Working buffer was added, the plate was covered, and incubated at room temperature for 30 minutes. After washing the plate six times with PBS-T, 100 µl per well 3,3,5,5-tetramentylbenzidine (TMB) substrate solution (Pierce, Rockford, Ill.) was added for 3-5 minutes and then the reaction was stopped with 50 µl Stop buffer (1N H$_2$SO$_4$) per well. The absorbance of each well was read at 450 nm.

Figure 3:
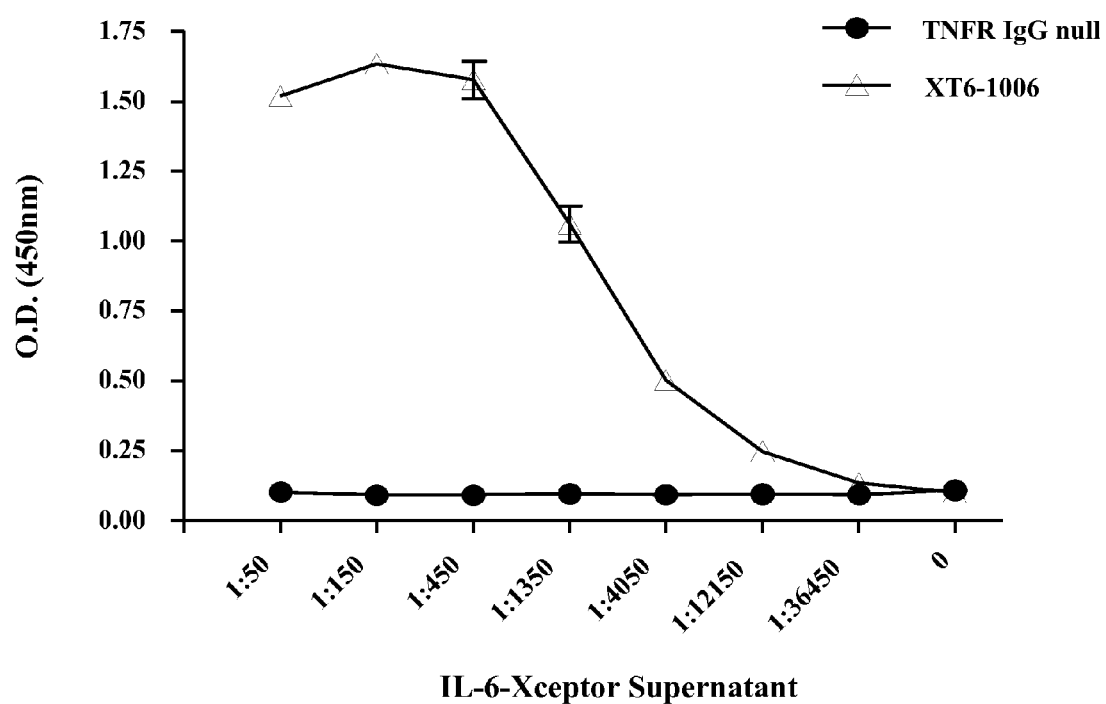
FIG. 3 shows that multi-specific fusion proteins containing one of various different Hyper-IL6 binding domains fused to a TNFR ectodomain can simultaneously bind to Hyper-IL6 and TNF-α as measured by ELISA.

The data in FIG. 3 demonstrates that Xceptor proteins can bind two ligands simultaneously (in this case TNF-α and Hyper IL6).

Example 5

Xceptor Blocking of Hyper IL6 Binding to gp130 by ELISA

Blocking of Hyper IL6 (IL6xR) binding to soluble gp130 receptor by Xceptor fusion proteins TRU(XT6)-1004, 1006, 1007, 1008, 1013, and 1019 (SEQ ID NO:610, 612, 613, 614, 619 and 625, respectively), was examined substantially as follows.

Added to each well of a 96-well plate was 100 µl human gp130-Fc chimera (R&D Systems, Minneapolis, Minn.) from a 0.25-0.5 µg/ml solution in PBS, pH 7.2-7.4. The plates were covered, and incubated overnight at 4° C. After washing four times with PBS-T, 250 µl Blocking buffer (PBS-T with 3% BSA or 10% normal goat serum) was added to each well, the plate was covered, and incubated at room temperature for 2 hours (or at 4° C. overnight). Serial five-fold dilutions in Working buffer starting at 50 µg/ml were made of the following samples: Xceptor TNFRSF1B::anti-HIL6 samples, positive controls human gp130-Fc chimera (R&D Systems) and anti-human IL-6R (R&D Systems), and negative controls anti-human IL-6 (R&D Systems), human IgG or Enbrel® (etanercept). Equal volumes of the serially diluted Xceptor samples were mixed with Hyper IL-6 (final Hyper IL-6 concentration of 2.5 ng/ml) and incubated at room temperature for 1 hour. After washing the plate three times with PBS-T, added in duplicate wells to the human gp130-Fc coated plate was 100 µl/well of the serially dilutions of Xceptor/HIL6 mixtures, human gp130-Fc chimera, anti-human IL-6R, anti-human IL-6, human IgG, and Enbrel® (etanercept), the plate was covered, and incubated at room temperature for about 1.5 hours. After washing the plate five times with PBS-T, 100 µl per well horse radish peroxidase-conjugated anti-mouse IgG-Fc (Pierce, Rockford, Ill.) diluted 1:10,000 in Working buffer was added, the plate was covered, and incubated at room temperature for 1 hour. After washing the plate six times with PBS-T, 100 µl per well 3,3,5,5-tetramentylbenzidine (TMB) substrate solution (Pierce) was added for about 5 to 15 minutes and then the reaction was stopped with 50 µl Stop buffer (1N $H_2SO_4$) per well. The absorbance of each well was read at 450 nm.

Figure 4:
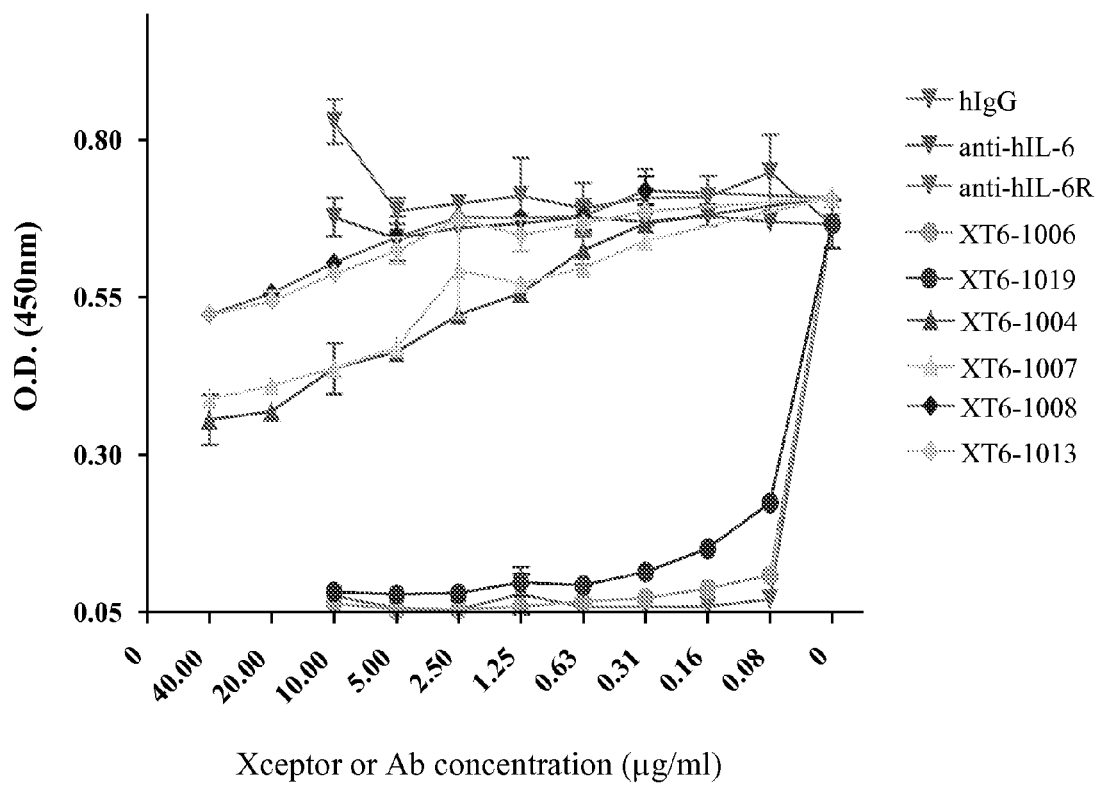
FIG. 4 shows that multi-specific fusion proteins containing one of various different Hyper-IL6 binding domains fused to a TNFR ectodomain block gp130 from binding to Hyper-IL6 as measured by ELISA.

The data in FIG. 4 demonstrate that Xceptor proteins comprising an anti-IL6xR binding domain can block soluble gp130 from binding to HIL6.

Example 6

Xceptor Blocking of IL6 and Hyper IL6 Induced Cell Proliferation

Blocking of IL6 or Hyper IL6 (IL6xR) induced cell proliferation of TF-1 cells was examined for Xceptor fusion proteins TRU(XT6)-1011, 1014, 1025, 1026, 1002, and TRU (X6T)-1019 (SEQ ID NO:617, 620, 631, 632, 608 and 670, respectively), substantially as follows.

Added to each well of a 96-well flat bottom plate were $0.3 \times 10^6$ TF-1 cells (human erythroleukemia cells) in the fresh growth medium (10% FBS-RPMI 1640; 2 mM L-glutamine; 100 units/ml penicillin; 100 µg/ml streptomycin; 10 mM HEPES; 1 mM sodium pyruvate; and 2 ng/ml Hu GM-CSF) one day before use in proliferation assay. The cells were then harvested and washed twice with assay medium (same as growth medium except without GM-CSF, cytokine-free), then resuspended at $1 \times 10^5$ cells/ml in assay medium. For blocking IL-6 activity, serial dilutions of a TNFSFR1B::anti-HIL-6 Xceptor of interest or antibody was pre-incubated with a fixed concentration of recombinant human IL-6 (rhIL-6) (R&D Systems, Minneapolis, Minn.) or hyper IL-6 (HIL-6) in 96-well plates for 1 hour at 37° C., 5% $CO_2$. Controls used included human IgG; human gp130-Fc chimera (R&D Systems); anti-hIL-6 antibody (R&D Systems); and anti-hIL-6R antibody (R&D Systems). After the pre-incubation period, $1 \times 10^4$1 cells (in 100 µl) was added to each well. The final assay mixture, in a total volume of 200 µl/well, containing TNFSFR1B::HIL-6, rhIL-6, or HIL-6 and cells was incubated at 37° C., 5% $CO_2$ for 72 hours. During the last 4-6 hours of culture, $^3$H-thymidine (20 µCi/ml in assay medium, 25 µl/well) was added. The cells were harvested onto UniFilter-96 GF/c plates and incorporated $^3$H-Thymidine was determined using TopCount reader (Packard). The data are presented as the Mean of cpm±SD of triplicates. The percentage of blocking=100−(test cpm−control cpm/maximum cpm−control cpm)*100.

Figure 5A:
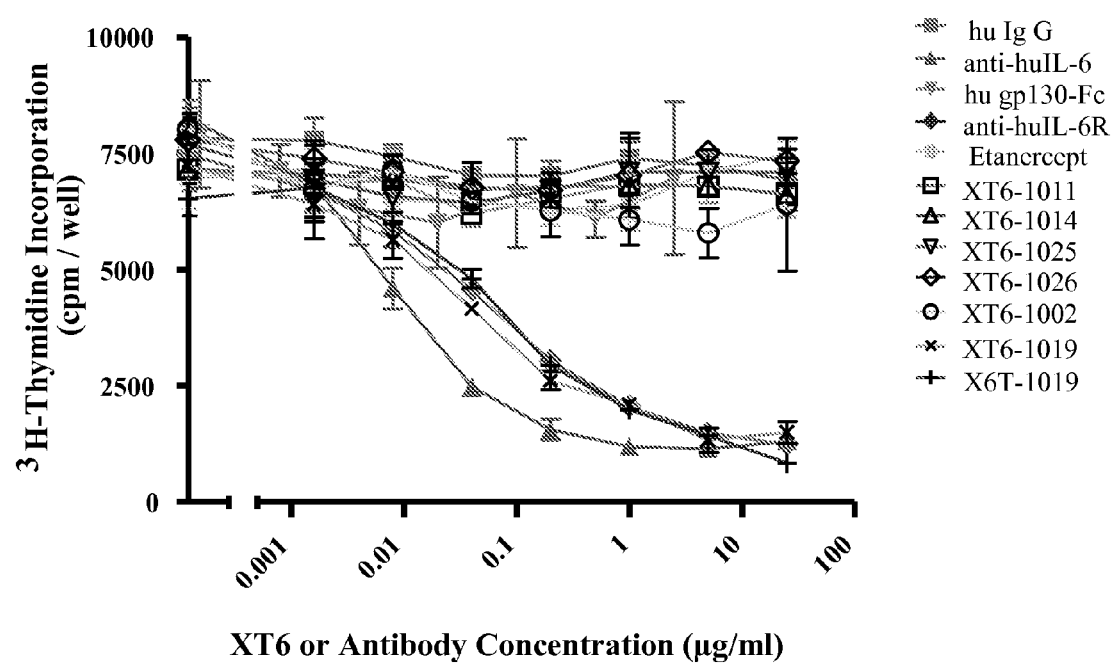
FIGS. 5A and 5B show that multi-specific fusion proteins containing one of various different Hyper-IL6 binding domains fused to a TNFR ectodomain block (A) IL6 or (B) Hyper-IL6 induced proliferation of TF-1 cells.
Figure 5B:
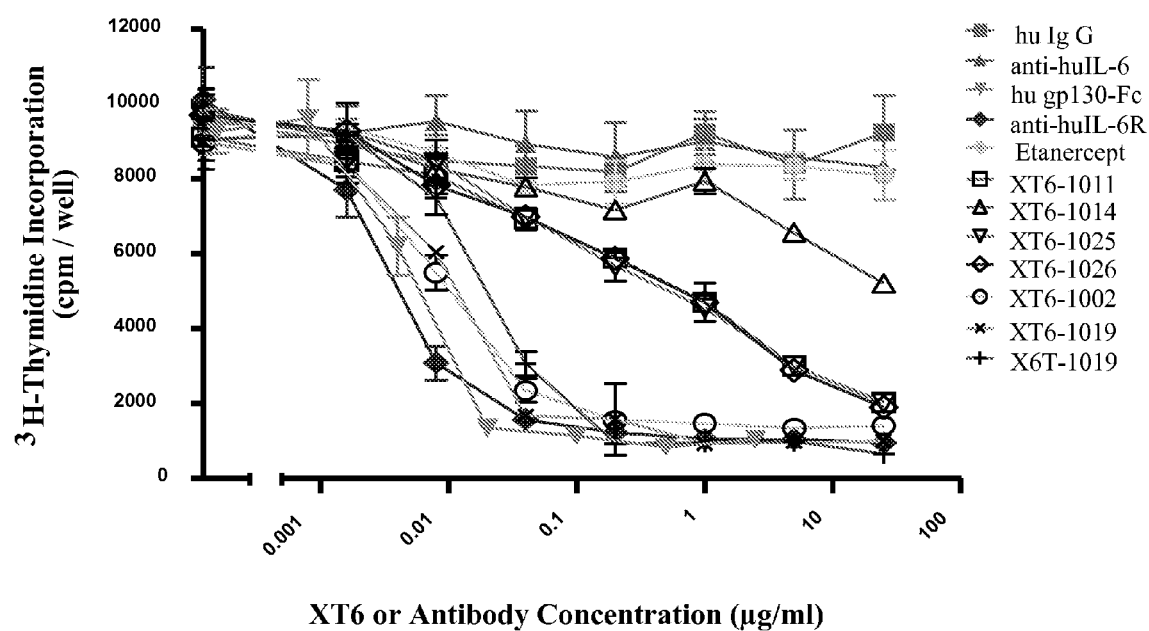

The data in FIG. 5A and FIG. 5B demonstrate that all Xceptor proteins, whether the TNFRSF1B ectodomain was on the amino- or carboxy terminus of the fusion protein molecules, can block cell proliferation induced by IL6 and Hyper IL6, respectively.

Example 7

Xceptor Blocking of TNF-α Binding to TNFR by ELISA

Blocking of TNF-α binding to TNF receptor by Xceptor fusion proteins TRU(XT6)-1004, 1006, 1007, 1008, 1013, and 1019 (SEQ ID NO:610, 612, 613, 614, 619 and 625, respectively), was examined substantially as follows.

Added to each well of a 96-well plate was 100 µl recombinant human TNFR2-Fc chimera (R&D Systems, Minneapolis, Minn.) from a 0.25-0.5 µg/ml solution in PBS, pH 7.2-7.4. The plates were covered, and incubated overnight at 4° C. After washing four times with PBS-T, 250 µl Blocking buffer (PBS-T with 3% BSA or 10% normal goat serum) was added to each well, the plate was covered, and incubated at room temperature for 2 hours (or at 4° C. overnight). Serial five-fold dilutions in Working buffer starting at 50 to 250 µM were made of the following samples: Xceptor TNFRSF1B:: anti-HIL6 samples, positive controls Enbrel® (etanercept) and anti-TNF-α (R&D Systems), and negative controls human gp130-Fc chimera (R&D Systems) and human IgG. Equal volumes of the serially diluted Xceptor samples were mixed with TNFα (final TNFα concentration of 2.5 ng/ml) and incubated at room temperature for 1 hour. After washing the plate three times with PBS-T, added in duplicate wells to the recombinant human TNFR2-Fc coated plate was 100 µl/well of the serially dilutions of Xceptor/TNFα mixture, Enbrel® (etanercept), anti-TNFα, human gp130-Fc chimera, and human IgG, the plate was covered, and incubated at room temperature for about 1.5 hours. After washing the plate five times with PBS-T, 100 µl per well of anti-human TNFα-biotin (R&D Systems) from a 200 ng/ml solution in Working buffer was added, the plate was covered, and incubated at room temperature for 1 to 2 hours. After washing the plate five times with PBS-T, 100 µl per well horse radish peroxidase-conjugated streptavidin (Jackson ImmunoResearch, West Grove, Pa.) diluted 1:1,000 in Working buffer was added, the plate was covered, and incubated at room temperature for 30 minutes. After washing the plate six times with PBS-T, 100 µl per well 3,3,5,5-tetramentylbenzidine (TMB) substrate solution (Pierce, Rockford, Ill.) was added for about 3 to 5 minutes and then the reaction was stopped with 50 µl Stop buffer (1N $H_2SO_4$) per well. The absorbance of each well was read at 450 nm.

Figure 6:
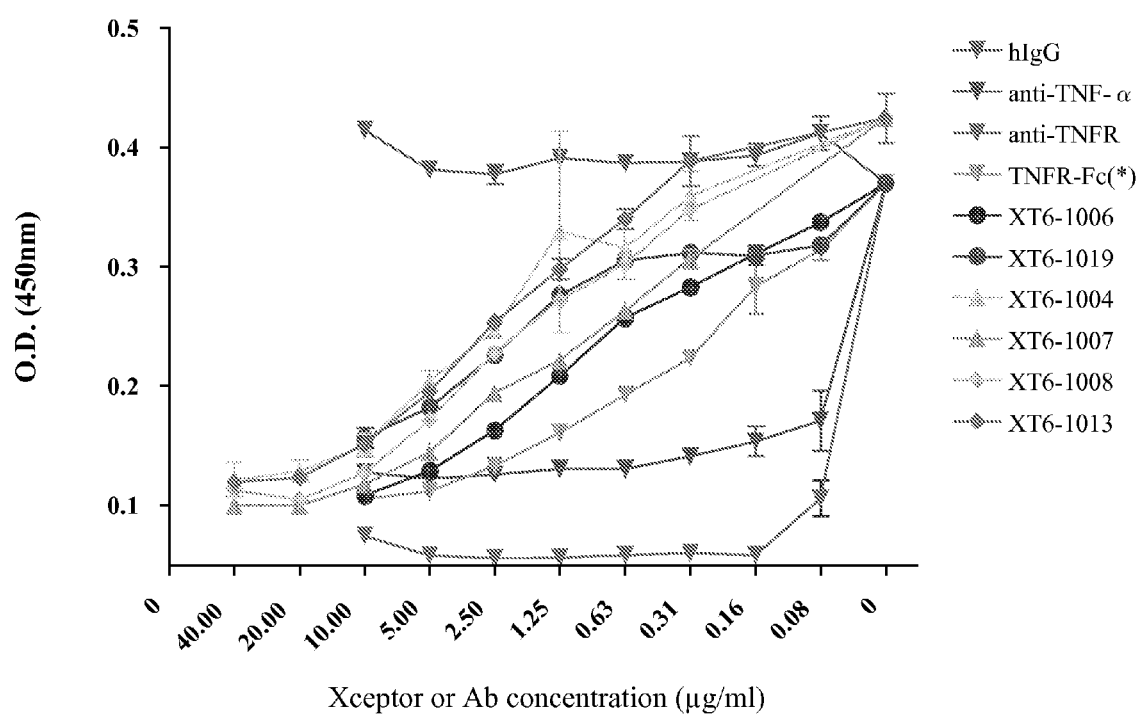
FIG. 6 shows that multi-specific fusion proteins containing one of various different Hyper-IL6 binding domains fused to a TNFR ectodomain block TNF-α from binding to TNFR as measured by ELISA.

The data in FIG. 6 show that Xceptor proteins blocked TNF-α binding to TNF receptor, which was approximately equivalent to blocking by TNFR-Fc.

Example 8

Xceptor Blocking of TNF-α Induced Cell Killing

Blocking of TNF-α induced killing of L929 cells was examined for Xceptor fusion proteins TRU(XT6)-1011, 1014, 1025, 1026, 1002, and TRU(X6T)-1019 (SEQ ID NO:617, 620, 631, 632, 608 and 670, respectively), substantially as follows.

A suspension of L929 mouse fibroblast cells (ATCC, Manassas, Va.) was prepared at a density of $2\times10^5$ cells/ml in culture medium (10% FBS-RPMI 1640; 2 mM L-glutamine; 100 units/ml penicillin; 100 μg/ml streptomycin; and 10 mM HEPES), then 100 μl was added to each well of a 96-well flat bottom black plate and incubated overnight at 37° C., 5% $CO_2$ in a humidified incubator. Xceptor TNFRSF1B::anti-HIL6 samples serially diluted in assay medium (same as culture medium but supplemented with 2% FBS) were mixed with an equal volume of recombinant human TNF-α (rhTNFα; R&D Systems, Minneapolis, Minn.), and incubated at 37° C., 5% $CO_2$ in a humidified incubator for 1 hour. Positive controls (i.e., those agents that block TNFα induced killing of L929 cells) included Enbrel® (etanercept), rhTNFR2-Fc chimera (R&D Systems, Minneapolis, Minn.), and anti-TNFα antibody (R&D Systems, Minneapolis, Minn.). Negative controls included assay medium alone (no TNF-α added) and antibody hIgG (with TNFα added). To analyze TNFα activity, culture medium was removed from the L929 cells and then each well received 50 μl of a TNFα/Xceptor or control mixture, and 50 μl actinomycin D (Sigma-Aldrich, St. Louis, Mo.) (from a freshly prepared working solution of 4 μg/ml). The cells were then incubated for 24 hrs at 37° C., 5% $CO_2$ in a humidified incubator. To measure cell viability, added to each well was 100 μl ATPlite 1 Step Reagent (PerkinElmer, Waltham, Mass.) according to the manufacturer's instructions, shaken for two minutes, and then luminescence is measured using a TopCount reader (Packard).

Figure 7:
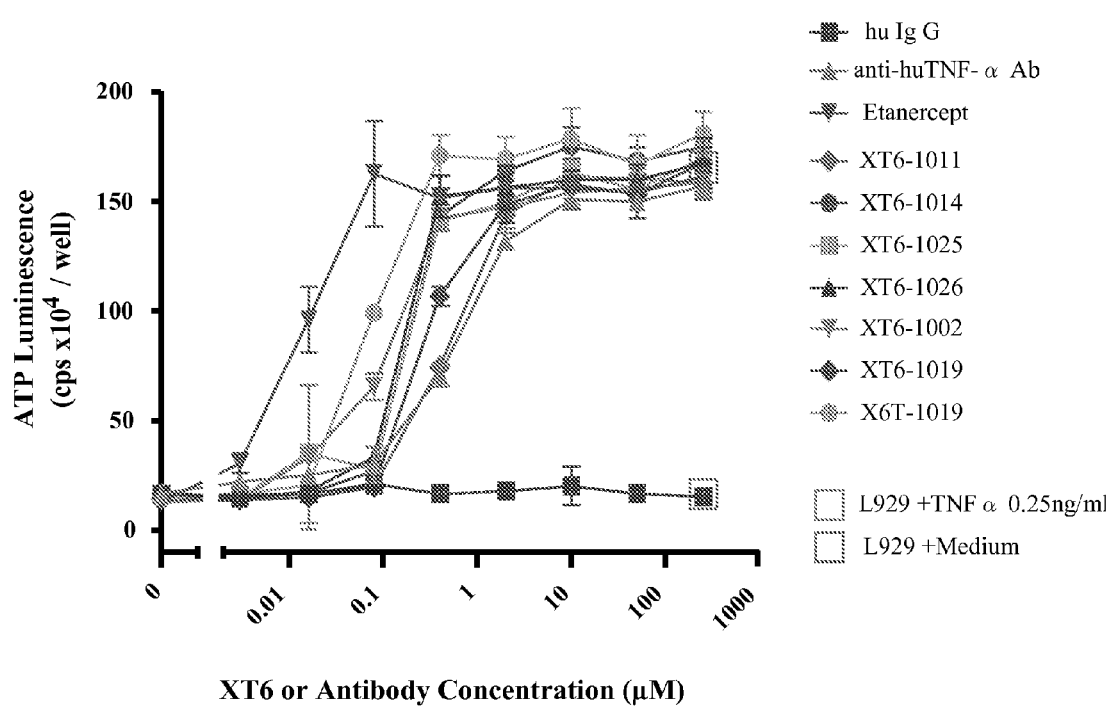
FIG. 7 shows that multi-specific fusion proteins containing a TNFR ectodomain fused to one of various different Hyper-IL6 binding domains block TNF-α induced killing of L929 cells.

The data in FIG. 7 demonstrate that all Xceptor proteins, whether the TNFRSF1B ectodomain was on the amino- or carboxy terminus of the fusion protein molecules, can block TNF-α induced cell killing in this assay.

Example 9

SMIP Binding to IL6 and Hyper IL6 by ELISA

Hyper-IL6 (HIL6 or IL6xR), recombinant human IL6 (rhIL6), and human soluble IL6R binding activity was examined for SMIP fusion proteins TRU(S6)-1004, 1007, 1008, 1013, 1018, 1019, 1029, and 1038 (SEQ ID NO:672, 673, 674, 676, 678, 679, 684 and 685, respectively), using essentially the same assay as in Example 1 except that SMIP proteins instead of Xceptor proteins were tested.

Figure 8:
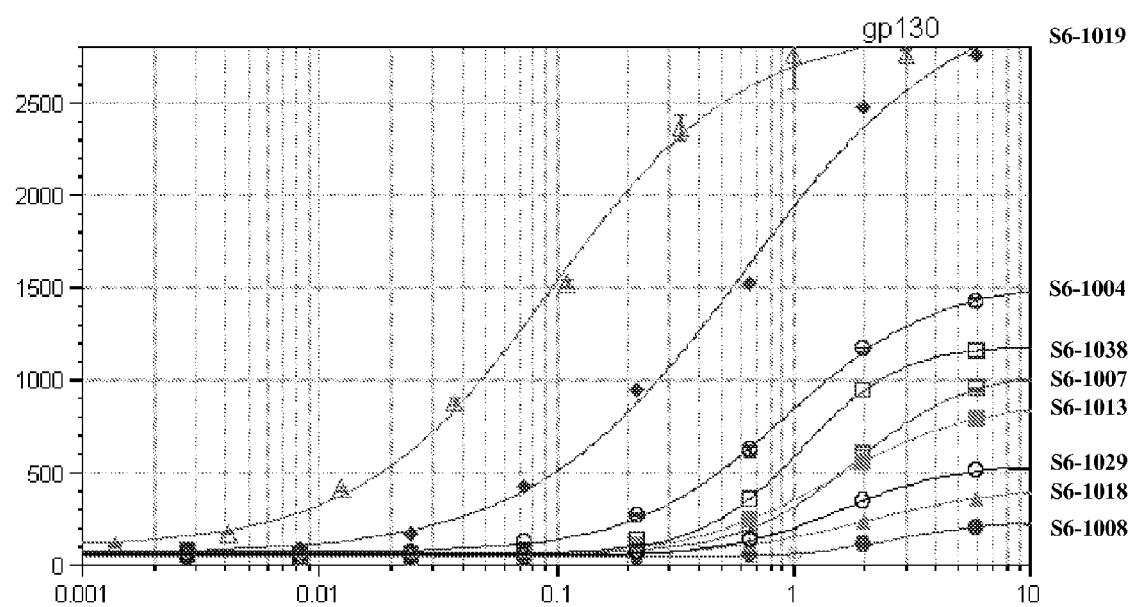
FIG. 8 shows that small modular immunopharmaceutical (SMIP™) fusion proteins containing one of various different Hyper-IL6 binding domains (referred to as TRU(S6)-1004, 1007, 1008, 1013, 1018, 1019, 1029 and 1038) bind to Hyper-IL6 as measured by ELISA.

The data in FIG. 8 demonstrate that all SMIP proteins can bind HIL6.

Example 10

Specificity of Binding to Hyper IL6 and not Other Gp130 Cytokines

The effect of Xceptor fusion proteins on induction of TF-1 cell proliferation by IL6 and the gp130 cytokines IL-11, leukemia inhibitory factor (LIF), oncostatin M (OSM) and cardiotrophin-1 (CT-1) was examined substantially as follows.

Added to each well of a 96-well flat bottom plate was $0.3\times10^6$ TF-1 cells (human erythroleukemia cells) in fresh growth medium (10% FBS-RPMI 1640, 2 mM L-glutamine, 100 units/ml penicillin, 100 μg/ml streptomycin, 10 mM HEPES, 1 mM sodium pyruvate and 2 ng/ml Hu GM-CSF) one day before use in the proliferation assay. The cells were harvested and washed twice with assay medium (same as growth medium except without GM-CSF, cytokine-free), then resuspended at $1\times10^5$ cells/ml in assay medium. For examining blocking of LIF, OSM, and CT-1 activity, serial dilutions of a TNFSFR1B::anti-HIL-6 xceptors TRU(XT6)-1002 (SEQ ID NO:608), TRU(XT6)-1019 (SEQ ID NO:625), TRU(XT6)-1022 (SEQ ID NO:628), and TRU(XT6)-1025 (SEQ ID NO:631) were pre-incubated with a fixed concentration of each gp130 cytokine individually or hyper IL-6 (HIL-6) in 96-well plates for 1 hour at 37° C., 5% $CO_2$. After the pre-incubation period, $1\times10^4$ cells (in 100 μl) were added to each well. The final assay mixture, in a total volume of 200 μl/well, containing TNFSFR1B::HIL-6, gp130 cytokine or HIL-6 and cells, was incubated at 37° C., 5% $CO_2$ for 72 hours. During the last 4-6 hours of culture, $^3$H-thymidine (20 μCi/ml in assay medium, 25 μl/well) was added. The cells were harvested onto UniFilter-96 GF/c plates and incorporated $^3$H-Thymidine was determined using TopCount reader (Packard). The percentage of blocking=100−(test cpm−control cpm/maximum cpm−control cpm)*100.

The results showed that the xceptor blocked IL6 activity but not IL-11, LIF, OSM or CT-1 (data not shown), and therefore bound to hyper IL6 but not to the other gp130 cytokines tested.

Example 11

SMIP Binding to Hyper IL6 by ELISA

Hyper-IL6 (HIL6) binding activity was examined for the humanized SMIP fusion proteins referred to as TRU(S6)-1063-TRU(S6)-1066 (light chain variable regions provided in SEQ ID NO:801-804, and heavy chain variable regions provided in SEQ ID NO:807-810, respectively) substantially as follows.

Added to each well of a 96-well plate was 100 ul of 1 μg/ml human hyper-IL6 (IL6R-IL6-mIgG) in PBS, pH 7.2-7.4. The plate was covered and incubated at 4° C. overnight. After washing five times with PBS-T, 250 μl Blocking buffer (PBS-T with 3% BSA) was added to each well, the plate was covered, and incubated at room temperature for 2 hours.

Serial three fold dilutions in 100 ul of Working Buffer (1% BSA in PBS-T), starting at 300 ng/ml, were made of the SMIP fusion proteins and, as a negative control, TNFR-Fc. The plate was covered and incubated at room temperature for 1 hour. After washing five times with PBS-T, 100 ul of an HRP-conjugated goat anti-human-Fc antibody (Pierce, Rockford, Ill.), diluted 1:1000, was added to each well. The plate was covered and incubated at room temperature for 1 hour. After washing five times with PBS-T, 100 μl of Quant-Blu™ substrate (Pierce, Rockford, Ill.) was added to each well. The plate was incubated at room temperature for 10-30 minutes, and fluorescence measured at 325/420 nm.

Figure 9:
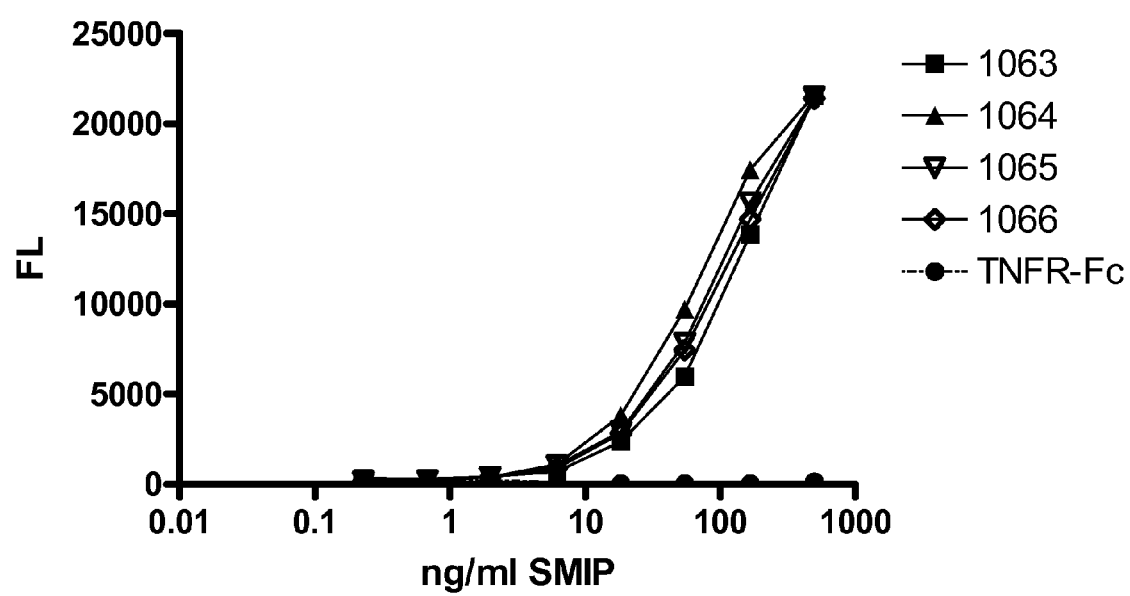
FIG. 9 shows that the SMIP fusion proteins referred to as TRU(S6)-1063-TRU(S6)-1066 bind to hyper-IL6 as measured by ELISA.

The data shown in FIG. 9 demonstrate that all SMIP fusion proteins tested can bind HIL6.

Example 12

Binding Affinity of Various IL6 Antagonist Fusion Proteins

Binding affinities and kinetic rate constants of interaction of hyper-IL6 (HIL6; monomer or dimer), and its components IL6 and sIL6R, with different anti-HIL6 binding domains in scFv, SMIP, Xceptor and reverse Xceptor formats were determined using a Biacore® T100 instrument (GE Healthcare, Piscataway, N.J.).

Anti-HIL6 SMIPS, Xceptors, and reverse Xceptors were captured by a monoclonal mouse anti-human Fc, which was covalently conjugated to a carboxylmethyl dextran (CM4) surface via amines using N-ethyl-N'-(3-dimethylaminopropyl)-carbodiimide hydrochloride and N-hydroxysuccinimide. The unoccupied sites of the activated surface were blocked by ethanolamine. The capturing antibody (referred to as anti-hFc) binds to the $C_H2$ domain of IgG Fc for all subclasses and showed no discernible dissociation from the captured HIL6-binders during the course of the assay. In every cycle, three different HIL6 binders were captured on flow cells 2, 3 and 4, while flow cell 1 was used as the reference cell. For each cycle, a single concentration of a single HIL6-related molecule was injected for 150 seconds at 35 microliters per minute, and then allowed to dissociate for 300 seconds. At the end of the cycle, the surface was regenerated gently using 3M $MgCl_2$, which dissociates protein bound to anti-hFc capture antibody. Multiple cycles were performed to study binding of monomeric or dimeric HIL6 at different concentrations, in the range of 0-100 nM, for each set of three HIL6 binders captured. HIL6 binders were reproducibly captured every cycle with CV not exceeding 2%. The experiment was performed at 25° C. Signal associated with binding to the reference cell was used to subtract for bulk refractive changes and blank (buffer-only) injections were used to correct for drift and system noise. The kinetic parameters and affinities were determined using BIAevaluation software. Anti-HIL6 scFv molecules were analyzed in the reverse orientation using a dimeric human HIL6/mouse IgG Fc fusion protein captured by an immobilized rabbit polyclonal anti-mouse IgG Fc antibody on the surface and injecting different concentrations of scFv over the surface. For the HIL6 components IL6 (eBioscience, catalog no. 14-8069) and sIL6R, a single 100 nM injection was performed to obtain a qualitative assessment of binding. Human gp130-human IgG Fc (R&D Systems) fusion protein was also captured and interrogated as a HIL6 binder for comparative purposes. Table 3 shows the results obtained for anti-HIL6 binders in SMIP and scFv formats.

TABLE 3

| ON CHIP | IN SOLUTION | | | | | | |
|---|---|---|---|---|---|---|---|
| | hu HIL6 Fc dimer | hu HIL6 AFH monomer | IL6 monomer | sIL6R Fc dimer | ΔsIL6R Fc dimer | sIL6R AFH monomer | ΔsIL6R AFH monomer |
| GP130 | ND | 0.68 | — | — | — | — | — |
| TRU(S6)-1002 (SEQ ID NO: 671) | 1.3 | 2 | — | — | — | — | — |
| SEQ ID NO: 671 (scFv) | 1.04 | ND | ND | ND | ND | ND | ND |
| TRU(S6)-1008 (SEQ ID NO: 674) | 110 | 310 | — | — | — | — | — |
| TRU(S6)-1013 (SEQ ID NO: 676) | 200 | 31 | — | — | — | — | — |
| TRU(S6)-1019 (SEQ ID NO: 679) | 2.7 | 2 | 0.44 | — | — | — | — |
| SEQ ID NO: 679 (scFv) | 1.46 | ND | ND | ND | ND | ND | ND |
| TRU(S6)-1022 (SEQ ID NO: 680) | 14 | 14 | 7.5 | — | — | — | — |
| TRU(S6)-1025 (SEQ ID NO: 682) | 4.4 | 2.6 | — | + | + | + | + |
| SEQ ID NO: 683 (scFv) | 21.7 | ND | ND | ND | ND | ND | ND |
| TRU(S6)-1029 (SEQ ID NO: 684) | 230 | 180 | — | — | — | — | — |

Numbers Indicate $K_D$ (nM)
ND Not Done,
+ Binding Observed,
− No Binding Observed Table 4 shows the results obtained for HIL6 binders in Xceptor format with a. TNFRSF1B ectodomain at the amino-terminus and an anti-HIL6xR binding domain at the carboxy terminus (TRU(XT6)) or in the reverse orientation (TRU(X6T)).

The data demonstrate that TRU(S6)-1002 strongly binds IL6:sIL6R complex and also weakly binds receptor at very high concentrations, but does not detectably bind IL6 under these conditions.

TABLE 4

| | IN SOLUTION | | | | | | | |
|---|---|---|---|---|---|---|---|---|
| ON CHIP | hu HIL6 Fc dimer | hu HIL6 AFH monomer | IL6 monomer | TNFα | sIL6R Fc dimer | ΔsIL6R Fc dimer | sIL6R AFH monomer | ΔsIL6R AFH monomer |
| Enbrel ® | ND | ND | ND | 0.0017 | ND | ND | ND | ND |
| XT6-1002 (SEQ ID NO: 608) | 61 | 4.9 | — | 0.0031 | — | — | — | — |
| XT6-1008 (SEQ ID NO: 614) | 300 | 440 | — | ND | — | — | — | — |
| X6T-1008 (SEQ ID NO: 669) | ND | ND | ND | ND | ND | ND | ND | ND |
| XT6-1013 (SEQ ID NO: 619) | 270 | 190 | — | ND | — | — | — | — |
| XT6-1019 (SEQ ID NO: 625) | 5.7 | 17 | 1.0 | ND | — | — | — | — |
| X6T-1019 (SEQ ID NO: 670) | 300 | 1.9 | 0.57 | ND | — | — | — | — |
| XT6-1022 (SEQ ID NO: 628) | 17 | 29 | 12 | ND | — | — | — | — |
| XT6-1025 (SEQ ID NO: 631) | 25 | 6.3 | — | ND | + | + | + | + |
| XT6-1029 (SEQ ID NO: 635) | 49 | 3000 | — | ND | — | — | — | — |

Numbers Indicate $K_D$ (nM)
ND Not Done,
+ Binding Observed,
− No Binding Observed These data show that anti-hyperIL6 binding domains in various formats bound monomer and dimer hyperIL6 with a range of affinities (from about 2 nM to about 3000 nM) and the highest affinity binders approach the affinity of gp130 for hyperIL6. Most binding domains are selective for hyperIL6 and do not appreciably bind IL6 or sIL6R. However, binding domains TRU(X6T)-1019 and TRU(XT6)-1022 are capable of tightly binding IL6 (at an affinity of about 0.44 nM to about 12 nM), while binding domain TRU(XT6)-1025 binds receptor (qualitative data only).

Example 13

IL6 Antagonist Binding to IL6:sIL6R Complex

Figure 10:
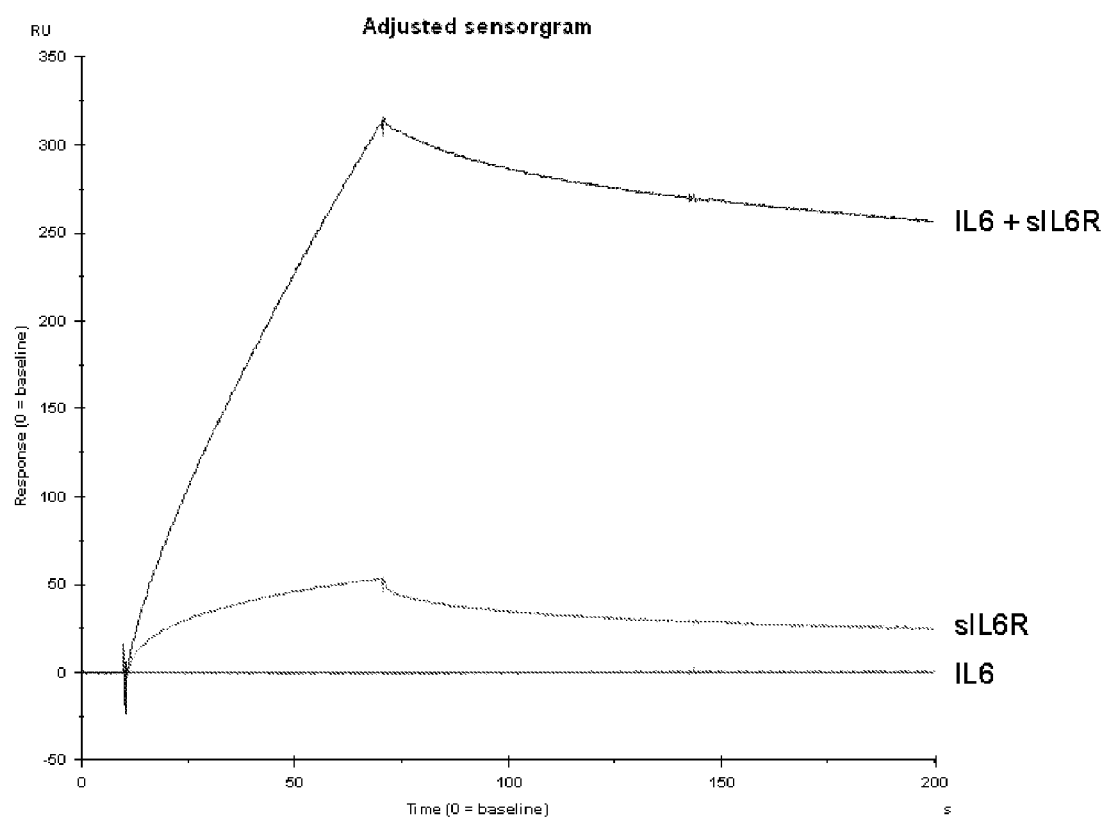
FIG. 10 shows that the SMIP fusion protein TRU(S6)-1002 binds IL6:sIL6R complex as measured by Biacore®.

Human IL6 (eBioscience, Catalog no. 14-8069) and soluble IL6R (R&D Systems, Catalog no. 227-SR/CF) were combined at 50 nM each in HEPES-buffered saline. We estimate that approximately 30 nM IL6:sIL6R complex is formed under these conditions. The complex was injected over a TRU(S6)-1002 (SEQ ID NO:671) SMIP surface. (TRU(S6)-1002 was captured as described above in Example 12). IL6 and sIL6R were also injected alone at 50 nM to assess individual binding. The sensorgram is shown in FIG. 10, which is reference- and blank-subtracted.

Example 14

Various IL6 Antagonist Binding Domains in Various Formats

Binding of anti-IL6 binding domains in antibody, SMIP, Xceptor and humanized antibody format to IL6 and hyper-IL6 (HIL6) was examined using Biacore® as described below. The mouse monoclonal antibodies employed in these studies were obtained from hybridomas AH64, AH65, BSF2-77, CLB-8, CLB-12, CLB-16, HH61-08 and HH61-10, which are all IL6 antagonist binding domains.

Anti-IL6 binding domains were captured using immobilized anti-mouse Fc polyclonal antibody in the case of anti-IL6 antibodies, or an anti-human Fc monoclonal in the case of SMIPs, Xceptors, and humanized SMIPs. IL6 binding to the anti-IL6 binding domains was studied using single cycle kinetics. Five sequential injections of IL6 were made per cycle starting with the lowest concentration of IL6 (6.4 pM) and progressing to the highest concentration (4,000 pM). The flow rate was 45 μL per minute and each injection of IL6 lasted 7 minutes. At the end of the highest IL6 concentration injection, IL6 was allowed to dissociate for 30 minutes. The data were fit to a one-to-one binding single cycle kinetics model. HIL6 binding was studied by injecting a single concentration of HIL6 (from 6.4-4,000 pM) per cycle for 7 minutes, and then allowing the bound HIL6 to dissociate for either 30 seconds (0 to 800 pM) or one hour (0 and 4,000 pM). These data were fit to a one-to-one binding model. All analysis was performed using BIAevaluation software. The kinetic rate constants and affinities are provided in Table 5.

TABLE 5

| On Chip | In Solution | $k_a$ (M$^{-1} \cdot$ s$^{-1}$) | $k_d$ (s$^{-1}$) | $K_D$ (pM) |
| --- | --- | --- | --- | --- |
| AH-65 mAb | IL6 | $3.2 \times 10^6$ | $2.2 \times 10^{-5}$ | 7 |
| TRU(S6)-1067 | IL6 | $4.0 \times 10^6$ | $4.5 \times 10^{-5}$ | 11 |
| TRU(S6)-1063 | IL6 | $3.9 \times 10^6$ | $1.9 \times 10^{-4}$ | 51 |
| TRU(S6)-1064 | IL6 | $4.2 \times 10^6$ | $2.0 \times 10^{-4}$ | 48 |
| AH-65 mAb | hyperIL6 | $2.0 \times 10^6$ | $2.4 \times 10^{-5}$ | 12 |
| TRU(S6)-1067 | hyperIL6 | $4.4 \times 10^6$ | $1.2 \times 10^{-4}$ | 27 |
| TRU(S6)-1063 | hyperIL6 | $3.6 \times 10^6$ | $1.8 \times 10^{-4}$ | 50 |
| TRU(S6)-1064 | hyperIL6 | $4.1 \times 10^6$ | $1.9 \times 10^{-4}$ | 46 |
| BSF2-77 mAb | IL6 | $4.8 \times 10^6$ | $2.0 \times 10^{-3}$ | 410 |
| TRU(S6)-1068 | IL6 | $5.9 \times 10^6$ | $7.9 \times 10^{-3}$ | 1,350 |
| TRU(XT6)-1068 | IL6 | $1.2 \times 10^6$ | $4.6 \times 10^{-3}$ | 3,734 |
| BSF2-77 mAb | hyperIL6 | $2.2 \times 10^6$ | $9.6 \times 10^{-4}$ | 444 |
| TRU(S6)-1068 | hyperIL6 | $3.4 \times 10^6$ | $3.2 \times 10^{-3}$ | 977 |
| TRU(XT6)-1068 | hyperIL6 | $6.6 \times 10^6$ | $4.3 \times 10^{-3}$ | 645 |
| AH-64 mAb | IL6 | $2.9 \times 10^6$ | $7.0 \times 10^{-5}$ | 24 |
| CLB-8 mAb | IL6 | $2.3 \times 10^6$ | $5.0 \times 10^{-5}$ | 22 |
| CLB-14 mAb | IL6 | $1.1 \times 10^6$ | $3.4 \times 10^{-4}$ | 315 |
| CLB-12 mAb | IL6 | $1.3 \times 10^6$ | $7.7 \times 10^{-4}$ | 577 |
| CLB-16 mAb | IL6 | $2.1 \times 10^6$ | $2.4 \times 10^{-4}$ | 112 |
| HH61-08 mAb | IL6 | $2.6 \times 10^6$ | $6.8 \times 10^{-4}$ | 268 |
| HH61-10 mAb | IL6 | $1.4 \times 10^6$ | $7.0 \times 10^{-5}$ | 49 |

The anti-IL6 binding domains in various formats all bound IL6 with a range of affinities (from about 7 pM to about 3,734 pM). Some of the binding domains were also able to bind hyperIL6. Of these, the binding domains from monoclonal antibodies AH65 and BSF2-77 were studied in detail and the affinity of these binding domains in various formats to hyperIL6 ranged from about 12 pM to about 977 pM. In general, the SMIP protein and bispecific xceptor formats have a binding affinity that is within 10 times that of the parent monoclonal antibodies.

Example 15

Binding Site Determination of Anti-IL6 Binding Domains

IL-6 binds the gp130 receptor through three conserved epitopes, referred to as sites I, II and III. In order for signaling via gp130 to occur, a hexameric signaling complex must be formed. IL-6 first forms a complex with IL6Rα by binding to site I. Site II is a composite epitope formed by the binary complex of IL6 with IL6Rα, which reacts with gp130. Finally, the hexameric signaling complex is formed by interaction of Site III with gp130 (Boulanger et al. (2003) Science 300:2101). The anti-IL6 antibodies AH65 and CL-16 have been shown to act as site III binders, while the anti-IL6 antibody CL-12 interacts with site II (Kalai et al. (1997) Eur. J. Biochem. 249:690). The binding site of the TRU-1002 binding domain disclosed herein was determined as follows.

To each well of two 96-well plates was added 100 ul of 1 ug/ml anti-human TNF-RII (R&D Systems, Minneapolis Minn.) in PBS, pH 7.2-7.4. The plates were covered and incubated overnight at 4° C. After washing five times with PBS-T, 250 μl Blocking buffer (PBS-T with 3% BSA) was added to each well, the plates covered, and incubated at room temperature for 2 hours.

After washing five times with PBS-T, 100 ul of TRU(XT6)-1002, at a concentration of 0.5 m/ml in Working Buffer (WB; PBS-T with 1% BSA), was added to each well of one plate. On the second plate, 100 ul of 0.5 mg/ml TRU(XT6)-1019 was added to each well. The plates were incubated at room temperature for 2 hours.

At the same time, two new plates were blocked with 250 ul Super Block (Pierce, Rockford Ill.) and incubated at room temperature for 1 hour. After washing five times with PBS-T, the following molecules, serially diluted two-fold in Working Buffer starting at 20 μg/ml (100 ul/well), were added to both plates: MQ2-13A5 (LM-E13), AH65 (LM-A02), CL-16 (LM-506), CL-12 (LM-S02), CL-14 (LM-S04) and S6-A2 (TRU(S6)-1002). Working Buffer only was included as a negative control. An equal volume (100 ul) of human hyper-IL6 at 20 ng/ml in Working Buffer was then added to each well, and the 200 μL mixed by pipeting up and down three times. The plates were incubated at room temperature for 1 hour.

After incubation, the 200 ul mixture in each well of one plate was transferred to the TRU(XT6)-1002 plate, which had been washed five times. The same was done for the second plate onto the TRU(XT6)-1019 plate. The plates were incubated for one hour at room temperature. After washing five times with PBS-T, 100 ul of biotinylated anti-IL6R (150 ng/ml) (R&D Systems, Minneapolis Minn.) was added to each well and the plates incubated at room temperature for 1 hour. After washing, 100 ul of streptavidin-HRP (Pierce, Rockford Ill.), diluted 1:20,000 in Working Buffer, was added to each well. The plates were incubated at room temperature for 30 minutes. After washing five times with PBS-T, 100 ul of Quant-Blu substrate (Pierce, Rockford, Ill.) was added to each well. The plate was incubated at room temperature for 10-30 minutes, and fluorescence measured at 325/420 nm.

Figure 11A:
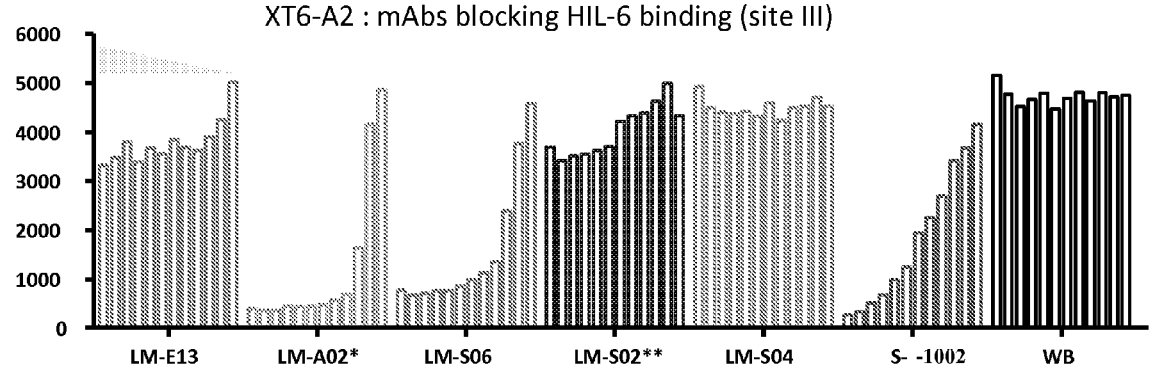
FIGS. 11A & B show the results of studies on the binding site of anti-IL6 binding domains disclosed herein.
Figure 11B:
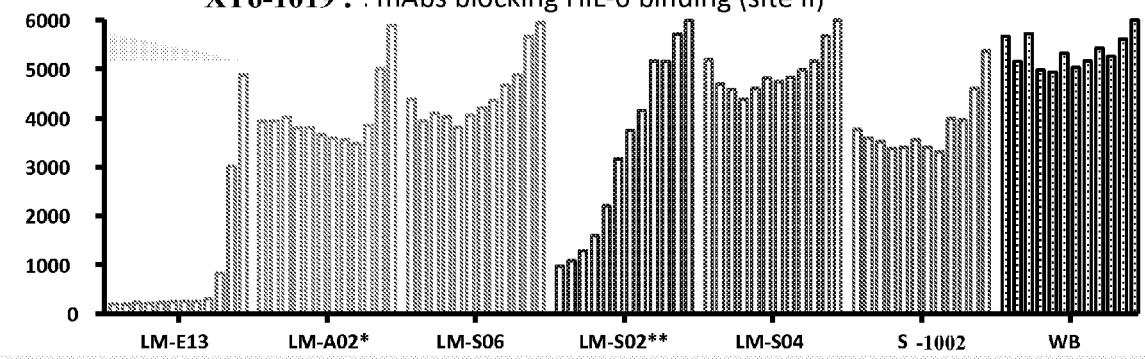

The results are shown in FIGS. 11A and 11B, and indicate that TRU(XT6)-1002 binds to Site III, while TRU(XT6)-1019 binds to Site II.

Example 16

SMIP and Xceptor Binding to IL6R on Liver Cells

The ability of TRU(S6)-1002, TRU(XT6)-1019 and the anti-IL6 antibody hu-PM1 to bind to IL6R on the liver-derived HepG2 cells was examined as follows.

HepG2 cells were washed in FACS Buffer and adjusted to $2 \times 10^6$ cells/mL in FACS Buffer (PBS+3% FBS). To wells of a 96-well plate were added 50 μL of this solution ($10^5$ cells/well). The plates were held at 37° C. until ready to add diluted test molecules. Serial dilutions of the test molecules were prepared in FACS Buffer to give a 2× working stock which was diluted to 1× when added to cells. The diluted test molecules were added to cells (50 μL/well) and the cells incubated for 20 min on ice. Whole IgG was used as a control. The cells were then washed two times with FACS Buffer and resuspended in phycoerythrin-conjugated goat anti-human antibody (Jackson Labs; diluted 1:200 in FACS Buffer). After being incubated for 20 min on ice in the dark, the cells were washed two times with FACS buffer, resuspended in 200 ul PBS and read on a LSRII™ flow cytometer (BD Biosciences, San Jose, Calif.).

Figure 12:
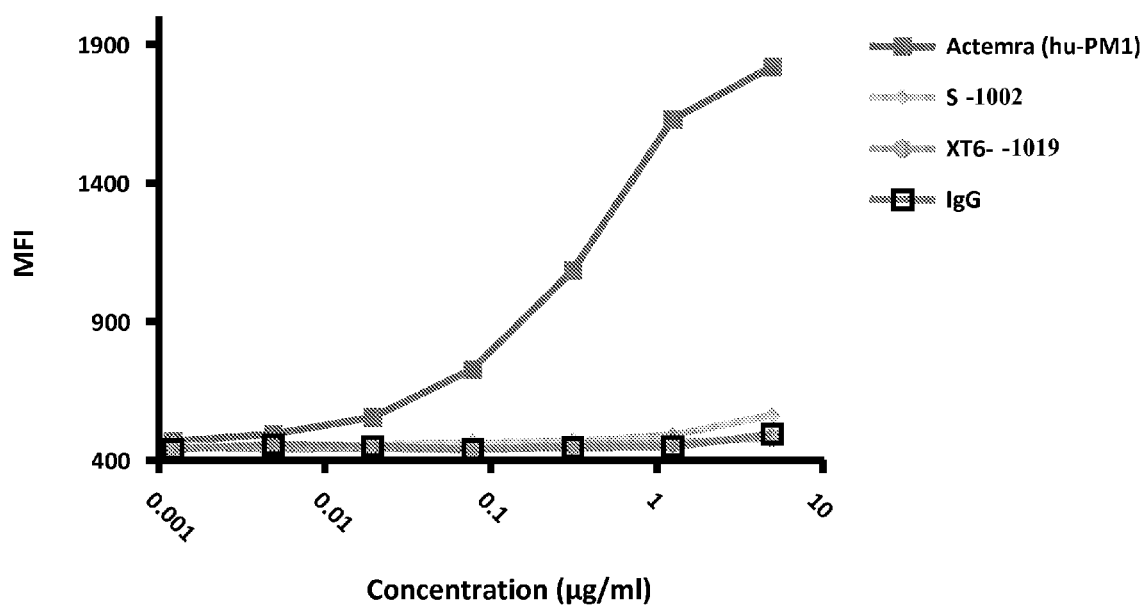
FIG. 12 shows that multi-specific fusion proteins containing a TNFR ectodomain fused to an IL6 binding domain did not bind to HepG2 cells.

As shown in FIG. 12, TRU(S6)-1002 and TRU(XT6)-1019 showed essentially no binding to HepG2 (liver) cells.

Example 17

SMIP and Xceptor Blocking of IL-6 and TNF Activity in Mice

The ability of SMIP and Xceptor fusion proteins disclosed herein to block IL-6 or TNF-induced production of serum amyloid A (SAA) protein in mice was examined as described below. SAA is one of the major acute-phase proteins in humans and mice. Prolonged elevation of plasma SAA levels is found in chronic inflammation and leads to amyloidosis which affects the liver, kidney and spleen (Rienhoff et al. (1990) Mol. Biol. Med. 7:287). Both IL-6 and TNF have been shown to induce SAA when administered alone (Benigni et al. (1996) Blood 87:1851; Ramadori et al. (1988) Eur. J. Immunol. 18:1259).

(a) Blocking of hyperIL-6 Activity

Female BALB/C mice were injected retro-orbitally with 0.2 ml PBS, or Enbrel® (200 µg), TRU(S6)-1002 (200 µg) or TRU(XT6)-1002 (300 µg or 500 µg) in PBS. One hour later, the mice were injected IP with 0.2 ml PBS or 2 µg human hyper-IL6 in PBS. Mouse serum was collected at 2 hours and 24 hours after the IP injection. The serum concentration of SAA was determined by ELISA, and concentration of sgp130 was determined by a Luminex-based mouse soluble receptor assay.

Figure 13:
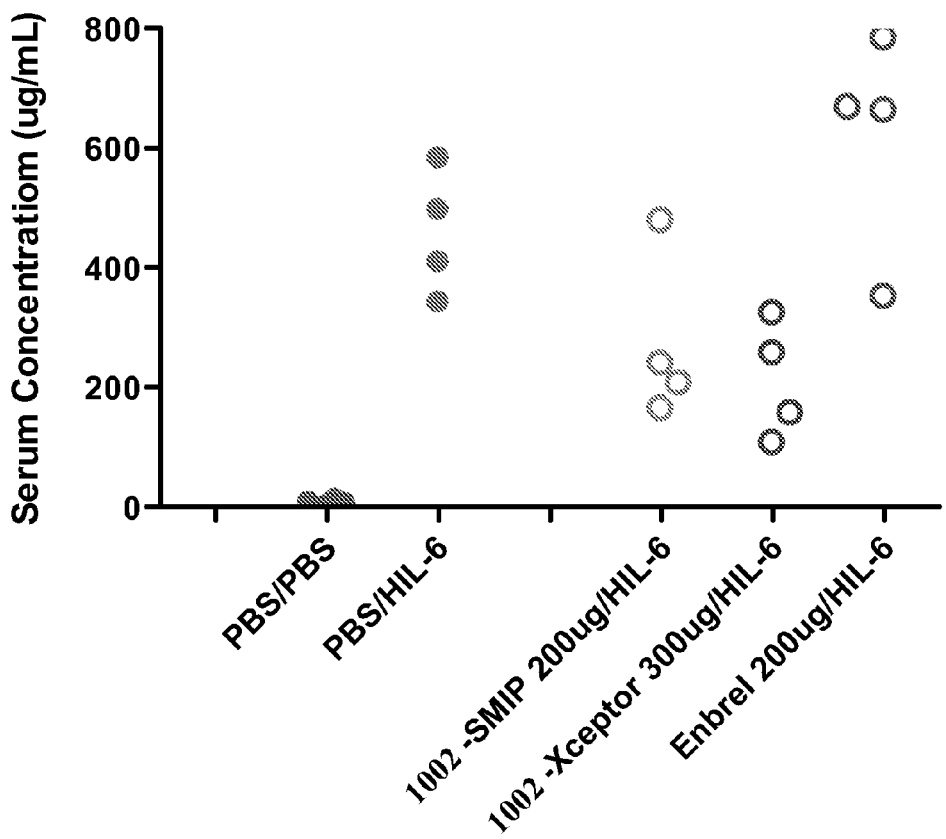
FIG. 13 shows that multi-specific fusion proteins containing a TNFR ectodomain fused to an IL6 binding domain blocked the HIL6-induced SAA response in mice.
Figure 14:
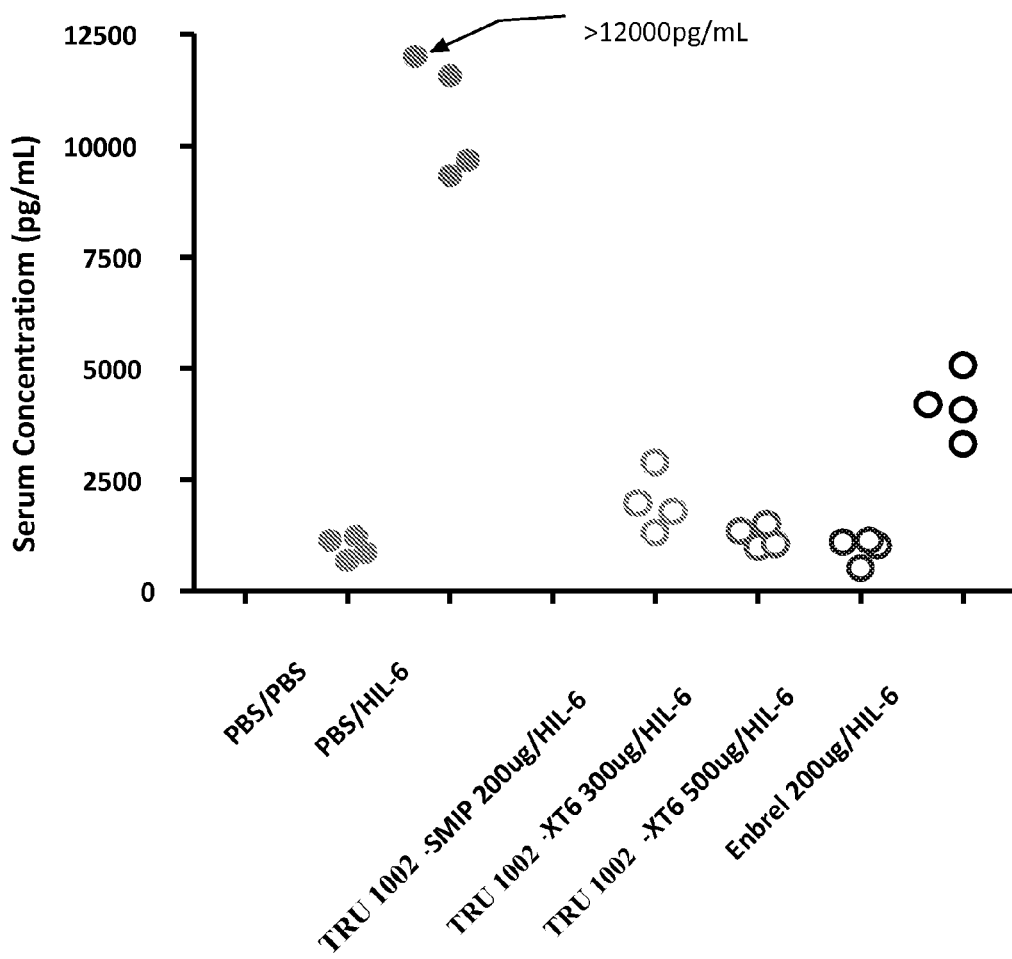
FIG. 14 shows that multi-specific fusion proteins containing a TNFR ectodomain fused to an IL6 binding domain blocked the HIL6-induced sgp130 response in mice.

As shown in FIGS. 13 and 14, TRU(S6)-1002 and TRU (XT6)-1002 blocked hyperIL6-induced expression of both sgp130 and SAA.

(b) Blocking of TNF Activity

Female BALB/C mice were injected retro-orbitally with 0.2 ml PBS, or Enbrel® (200 µg), TRU(S6)-1002 (200 µg) or TRU(XT6)-1002 (300 µg) in PBS. One hour later, the mice were injected IP with 0.2 ml PBS or 0.5 µg/mouse TNF-α in PBS. Mouse serum was collected at 2 hours and 24 hours after the IP injection. The serum concentration of SAA was determined by ELISA, and concentration of sgp130 was determined by a Luminex-based mouse soluble receptor assay.

Figures 15A, 15B:
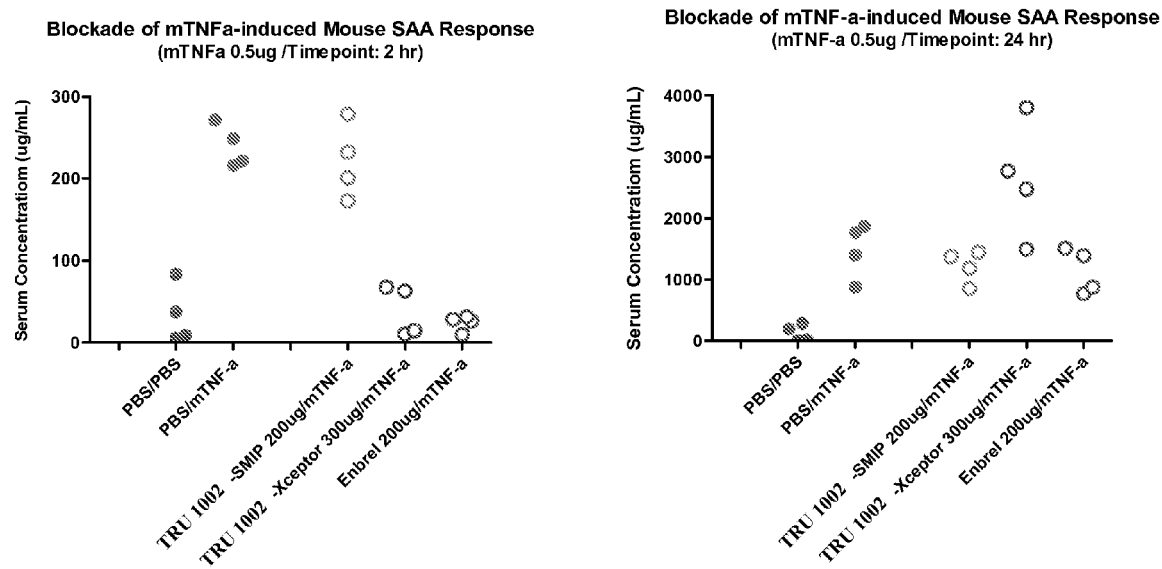
FIGS. 15A and B show the results of studies on the ability of multi-specific fusion proteins containing a TNFR ectodomain fused to an IL6 binding domain to block the TNFα-induced SAA response in mice, at 2 hours and 24 hours post-administration, respectively.

As shown in FIGS. 15A and B, xceptor TRU(XT6)-1002 blocked TNFα-induced expression of SAA, with the level of SAA observed at 2 hours post-injection being similar to that seen with Enbrel®.

Example 18

Xceptor Activity In Vivo

The therapeutic efficacy of fusion proteins described herein is examined in animal models of disease as described below.

(a) Multiple Myeloma

The activity of fusion proteins is examined in at least one of two well characterized mouse models of multiple myeloma, namely the 5T2 multiple myeloma (5T2MM) model and the 5T33 multiple myeloma (5T33MM) model. In the 5T33 model, mice are treated with fusion proteins from the time of injection of tumor cells (prophylactic mode). In the 5T2MM model, mice are treated from the onset of the disease (therapeutic mode). The effect of treatment on tumor development and angiogenesis is assessed in both models, with bone studies also being performed in the 5T2MM model.

The 5TMM murine model of myeloma was initially developed by Radl et al. (J. Immunol. (1979) 122:609; see also Radl et al., Am. J. Pathol. (1988) 132:593; Radl J. Immunol. Today (1990) 11:234). Its clinical characteristics resemble the human disease closely: the tumor cells are located in the bone marrow, the serum paraprotein concentration is a measure of disease development, neovascularization is increased in both the 5T2MM and 5T33MM models (Van Valckenborgh et al., Br J Cancer (2002) 86:796), and in certain lines a clear osteolytic bone disease develops. The 5T2MM model includes moderate tumor growth and the development of osteolytic bone lesions. These lesions are associated with a decrease in cancellous bone volume, decreased bone mineral density and increased numbers of osteoclasts (Croucher et al. Blood (2001) 98:3534). The 5T33MM model has a more rapid tumor take and, in addition to the bone marrow, tumor cells also grow in the liver (Vanderkerken et al. Br. J. Cancer (1997) 76:451).

The 5T2 and 5T33MM models have been extensively characterized. Specific monoclonal antibodies have been raised against the idiotype of both 5T2 and 5T33MM allowing the detection, with great sensitivity, of the serum paraprotein by ELISA, and the specific staining of the tumor cells both by FACS analysis and immunostaining of histological sections (Vanderkerken et al., 1997). The sequence analysis of the VH gene enables the detection of cells by RT-PCR and Northern blot analysis (Zhu et al. Immunol. (1998) 93:162). The 5TMM models, which can be used for both in vitro and in vivo experiments, generate a typical MM disease and different methods are available to assess tumor load in the bone marrow, serum paraprotein concentrations, bone marrow angiogenesis (by measuring the microvessel density) and osteolytic bone lesions (by a combination of radiography, densitometry and histomorphometry). The investigation of these latter parameters allow the use of the 5TMM models in a preclinical setting and study of the growth and biology of the myeloma cells in a complete syngeneic microenvironment. Both molecules targeting the MM cells themselves and molecules targeting the bone marrow microenvironment can be studied. Specifically, while the 5T33MM model can be used to study both the microenvironment and the MM cells themselves, the 5T2MM model can also be used to study the myeloma associated bone disease.

To study the prophylactic efficacy of the fusion proteins disclosed herein, C57BL/KaLwRij mice are injected with $2 \times 10^6$ 5T33 MM cells and with fusion protein on day 0. Mice are sacrificed at day 28 and tumor development is assessed by determining serum paraprotein concentration and the percentage of tumor cells on isolated bone marrow cells (determined by flow cytometry with anti-idiotype antibodies or by cytosmears). The weight of spleen and liver is determined and these organs are fixed in 4% formaldehyde for further analysis. Bone samples are fixed for further processing including CD31 immunostaining on paraffin sections and quantification of microvessel density.

To study the therapeutic efficacy of the fusion proteins disclosed herein, mice are injected with 5T2MM cells on day 0, and fusion protein is administered following the onset of disease, as determined by the presence of detectable levels of serum paraprotein. Mice are sacrificed approximately five weeks following administration of fusion protein, and tumor development is assessed as described above for the prophylactic study. In addition, bone analysis is performed using X-rays to determine the number of bone lesions and trabecular bone area, and TRAP staining to assess the number of osteoclasts.

(b) Rheumatoid Arthritis

The therapeutic efficacy of the fusion proteins disclosed herein is examined in at least one of two murine models of rheumatoid arthritis (RA), namely the collagen induced arthritis (CIA) and glucose-6-phosphate isomerase (G6PI) models. Each of these models has been shown by others to be useful for predicting efficacy of certain classes of therapeutic drugs in RA (see, Holmdahl (2000) Arthritis Res. 2:169; Holmdahl (2006) Immunol. Lett. 103:86; Holmdahl (2007) Methods Mol. Med. 136:185; McDevitt, H. (2000) Arthritis Res. 2:85; Kamradt and Schubert (2005) Arthritis Res. Ther. 7:20).

(i) CIA Model

The CIA model is the best characterized mouse model of arthritis in terms of its pathogenesis and immunological basis. In addition, it is the most widely used model of RA and, although not perfect for predicting the ability of drugs to inhibit disease in patients, is considered by many to be the model of choice when investigating potential new therapeutics for RA (Jirholt et al. (2001) Arthritis Res. 3:87; Van den Berg (2002) Curr. Rheumatol. Rep. 4:232; Rosloniec (2003) Collagen-Induced Arthritis. In Current Protocols in Immunology, eds. Coligan et al., John Wiley & Sons, Inc, Hoboken, N.J.).

In the CIA model, arthritis is induced by immunization of male DBA/1 mice with collagen II (CII) in Complete Freund's Adjuvant (CFA). Specifically, mice are injected intradermally/subcutaneously with CII in CFA on Day −21 and boosted with CII in Incomplete Freund's Adjuvant (IFA) on Day 0. Mice develop clinical signs of arthritis within days of the boost with CII/IFA. A subset of mice (0% to 10%) immunized with CII/CFA develop signs of arthritis on or around Day 0 without a boost and are excluded from the experiments. In some CIA experiments, the boost is omitted and mice are instead treated with Xceptor or control starting 21 days after immunization with CII/CFA (i.e. the day of first treatment is Day 0).

Mice are treated with fusion protein, vehicle (PBS), or negative or positive control in a preventative and/or therapeutic regimen. Preventative treatment starts on Day 0 and continues through the peak of disease in control (untreated) mice. Therapeutic treatment starts when the majority of mice show mild signs of arthritis. Enbrel®, which has been shown to have good efficacy in both the CIA and G6PI-induced models of arthritis, is used as a positive control. Data collected in every experiment includes clinical scores and cumulative incidence of arthritis. Clinical signs of arthritis in the CIA model are scored using a scale from 0 to 4 as shown in Table 6 below.

TABLE 6

| Score | Observations |
|---|---|
| 0 | No apparent swelling or redness |
| 1 | Swelling/redness in one to three digits |
| 2 | Redness and/or swelling in more than three digits, mild swelling extending into the paw, swollen or red ankle, or mild swelling/redness of forepaw |
| 3 | Swollen paw with mild to moderate redness |
| 4 | Extreme redness and swelling in entire paw |

(ii) G6PI Model

In the G6PI model, arthritis is induced by immunization of DBA/1 mice with G6PI in adjuvant (Kamradt and Schubert (2005) Arthritis Res. Ther. 7:20; Schubert et al., (2004) J. Immunol. 172:4503; Bockermann et al. (2005) Arthritis Res. Ther. 7:R1316; Iwanami et al. (2008) Arthritis Rheum. 58:754; Matsumoto et al., (2008) Arthritis Res. Ther. 10:R66). G6PI is an enzyme present in virtually all cells in the body and it is not known why immunization induces a joint specific disease. A number of agents, such as CTLA4-Ig, TNF antagonists (e.g., Enbrel®) and anti-IL6 receptor monoclonal antibody, have been shown to inhibit development of arthritis in the G6PI model.

Male DBA/1 mice are immunized with G6PI in Complete Freund's Adjuvant (CFA) in order to induce arthritis. Specifically, mice are injected intradermally/subcutaneously with G6PI in CFA on Day 0 and develop clinical signs of arthritis within days of the immunization. As with the CIA model discussed above, mice are treated with fusion protein, vehicle (PBS), or negative or positive control in a preventative and/or therapeutic regimen. Preventative treatment starts on Day 0 and continues through the peak of disease in control mice. Therapeutic treatment starts when the majority of mice show mild signs of arthritis. Enbrel®, which has been shown to have good efficacy in both the CIA and G6PI-induced models of arthritis, is used as a positive control. Data collected in every experiment includes clinical scores and cumulative incidence of arthritis. Clinical signs of arthritis in the G6PI model are scored using a scale similar to that employed for the CIA model.

(c) Polycystic Kidney Disease

The efficacy of the fusion proteins disclosed herein in the treatment of polycystic kidney disease is tested in murine models as described in Gattone et al., Nat. Med. (2003) 9:1323; Torres et al. Nat. Med. (2004) 10:363; Wang et al. J. Am. Soc. Nephrol. (2005) 16:846; and Wilson (2008) Curr. Top. Dev. Biol. 84:311.

While this invention has been described in conjunction with the specific embodiments outlined above, it is evident that many alternatives, modifications and variations will be apparent to those skilled in the art. Accordingly, the embodiments of this disclosure as set forth above are intended to be illustrative, not limiting. Various changes may be made without departing from the spirit and scope of this disclosure as defined in the following claims. All publications referenced herein are incorporated herein by reference as though fully set forth.

SEQ ID NOS:1-845 are set out in the attached Sequence Listing. The codes for nucleotide sequences used in the attached Sequence Listing, including the symbol "n," conform to WIPO Standard ST.25 (1998), Appendix 2, Table 1.

SEQUENCE LISTING (845 sequences)

SEQ ID NO: 1 - protein, 11 aa, Artificial Sequence
  Made in a lab
SGEKLGDIYAS

SEQ ID NO: 2 - protein, 7 aa, Artificial Sequence
  Made in a lab
QDTKRPS

SEQ ID NO: 3 - protein, 8 aa, Artificial Sequence
  Made in a lab
QAWDSSTV

SEQ ID NO: 4 - protein, 14 aa, Artificial Sequence
  Made in a lab
SGTDSDVGGYNHVS

SEQ ID NO: 5 - protein, 7 aa, Artificial Sequence
  Made in a lab
DVDHRPS

SEQ ID NO: 6 - protein, 10 aa, Artificial Sequence
  Made in a lab
SSYRSGSTYV

SEQ ID NO: 7 - protein, 11 aa, Artificial Sequence
  Made in a lab
RASQSISSYLN

SEQ ID NO: 8 - protein, 7 aa, Artificial Sequence
  Made in a lab
AASALQS

SEQ ID NO: 9 - protein, 9 aa, Artificial Sequence
  Made in a lab
QQSYSPPVT

SEQ ID NO: 10 - protein, 11 aa, Artificial Sequence
  Made in a lab
RASQSISSWLA

SEQ ID NO: 11 - protein, 7 aa, Artificial Sequence
  Made in a lab
KASSLES

SEQ ID NO: 12 - protein, 8 aa, Artificial Sequence
  Made in a lab
QQYNSYWT

SEQ ID NO: 13 - protein, 11 aa, Artificial Sequence
  Made in a lab
RASQSVSSYLA

SEQ ID NO: 14 - protein, 7 aa, Artificial Sequence
  Made in a lab
DASNRAT

SEQ ID NO: 15 - protein, 10 aa, Artificial Sequence
  Made in a lab
QQRSNWPPFT

SEQ ID NO: 16 - protein, 11 aa, Artificial Sequence
  Made in a lab
QTSQSIDRYLN

SEQ ID NO: 17 - protein, 7 aa, Artificial Sequence
  Made in a lab
AASSLQS

SEQ ID NO: 18 - protein, 9 aa, Artificial Sequence
  Made in a lab
QQSYRTPRT

SEQ ID NO: 19 - protein, 12 aa, Artificial Sequence
  Made in a lab
RASQSVSSSYLA

SEQ ID NO: 20 - protein, 7 aa, Artificial Sequence
  Made in a lab
GASSRAT

SEQ ID NO: 21 - protein, 10 aa, Artificial Sequence
  Made in a lab
QQYGSSPLWT

SEQ ID NO: 22 - protein, 11 aa, Artificial Sequence
  Made in a lab
RASQSISSYLN

SEQ ID NO: 23 - protein, 7 aa, Artificial Sequence
  Made in a lab
AASSLQS

SEQ ID NO: 24 - protein, 9 aa, Artificial Sequence
  Made in a lab
QQSYSTPRT

SEQ ID NO: 25 - protein, 11 aa, Artificial Sequence
  Made in a lab
RASQSISTSLA

SEQ ID NO: 26 - protein, 8 aa, Artificial Sequence
  Made in a lab
YDASKRAS

SEQ ID NO: 27 - protein, 11 aa, Artificial Sequence
  Made in a lab
QLRINWPPEFT

SEQ ID NO: 28 - protein, 11 aa, Artificial Sequence
  Made in a lab
RASRGVITWLN

SEQ ID NO: 29 - protein, 7 aa, Artificial Sequence
  Made in a lab
GASTLQT

SEQ ID NO: 30 - protein, 9 aa, Artificial Sequence
  Made in a lab
QQTHSFPLT

SEQ ID NO: 31 - protein, 11 aa, Artificial Sequence
  Made in a lab
SGDKLGEKYVS

SEQ ID NO: 32 - protein, 7 aa, Artificial Sequence
  Made in a lab
QDTKRPS

SEQ ID NO: 33 - protein, 9 aa, Artificial Sequence
  Made in a lab
QTWDSDTYV

SEQ ID NO: 34 - protein, 11 aa, Artificial Sequence
  Made in a lab
RASQSISSYLN

SEQ ID NO: 35 - protein, 7 aa, Artificial Sequence
  Made in a lab
AASSLQS

SEQ ID NO: 36 - protein, 9 aa, Artificial Sequence
  Made in a lab
QQSYSTLWT

SEQ ID NO: 37 - protein, 11 aa, Artificial Sequence
  Made in a lab
RASQSVRSYLA

SEQ ID NO: 38 - protein, 7 aa, Artificial Sequence
  Made in a lab
DASNRAT

SEQ ID NO: 39 - protein, 9 aa, Artificial Sequence
  Made in a lab
QQYDNLPLT

SEQ ID NO: 40 - protein, 11 aa, Artificial Sequence
  Made in a lab
RTSQSVATYVN

SEQ ID NO: 41 - protein, 7 aa, Artificial Sequence
  Made in a lab
AASSLQS

SEQ ID NO: 42 - protein, 9 aa, Artificial Sequence
  Made in a lab
QQSYSVPIT

SEQ ID NO: 43 - protein, 11 aa, Artificial Sequence
  Made in a lab
RASQSMSNWLA

SEQ ID NO: 44 - protein, 7 aa, Artificial Sequence
  Made in a lab
DVFTLKS

SEQ ID NO: 45 - protein, 10 aa, Artificial Sequence
  Made in a lab
QQYSDYSGIT

SEQ ID NO: 46 - protein, 13 aa, Artificial Sequence
  Made in a lab
SGSSSNIGSKVVY

SEQ ID NO: 47 - protein, 7 aa, Artificial Sequence
  Made in a lab
RNDQRPS

SEQ ID NO: 48 - protein, 12 aa, Artificial Sequence
  Made in a lab
AAWDDSLSGRWV

SEQ ID NO: 49 - protein, 11 aa, Artificial Sequence
  Made in a lab
RASQSISSWLA

SEQ ID NO: 50 - protein, 7 aa, Artificial Sequence
  Made in a lab
KASGLES

SEQ ID NO: 51 - protein, 9 aa, Artificial Sequence
  Made in a lab
QQYNSYPFT

SEQ ID NO: 52 - protein, 11 aa, Artificial Sequence
  Made in a lab
QASRDISIYLN

SEQ ID NO: 53 - protein, 7 aa, Artificial Sequence
  Made in a lab
GASTLRS

SEQ ID NO: 54 - protein, 9 aa, Artificial Sequence
  Made in a lab
QKYNSAPYT

SEQ ID NO: 55 - protein, 11 aa, Artificial Sequence
  Made in a lab
RASQGISSWLA

SEQ ID NO: 56 - protein, 7 aa, Artificial Sequence
  Made in a lab
AASSLQS

SEQ ID NO: 57 - protein, 9 aa, Artificial Sequence
  Made in a lab
QQANSFPLT

SEQ ID NO: 58 - protein, 11 aa, Artificial Sequence
  Made in a lab
RASQSINTYLA

SEQ ID NO: 59 - protein, 7 aa, Artificial Sequence
  Made in a lab
DASNRAT

SEQ ID NO: 60 - protein, 9 aa, Artificial Sequence
  Made in a lab
QQYGRSRYT

SEQ ID NO: 61 - protein, 11 aa, Artificial Sequence
  Made in a lab
RASQGISNYLA

SEQ ID NO: 62 - protein, 7 aa, Artificial Sequence
  Made in a lab
AASTLQS

SEQ ID NO: 63 - protein, 9 aa, Artificial Sequence
  Made in a lab
QQSDNIPYT

SEQ ID NO: 64 - protein, 13 aa, Artificial Sequence
  Made in a lab
SGSSSNIGSNTVN

SEQ ID NO: 65 - protein, 7 aa, Artificial Sequence
  Made in a lab
SNNQRPS

SEQ ID NO: 66 - protein, 11 aa, Artificial Sequence
  Made in a lab
AAWDDSLNGYV

SEQ ID NO: 67 - protein, 11 aa, Artificial Sequence
  Made in a lab
RASQSISTYLN

SEQ ID NO: 68 - protein, 7 aa, Artificial Sequence
  Made in a lab
EATNLQS

SEQ ID NO: 69 - protein, 9 aa, Artificial Sequence
  Made in a lab
QQANNFPFT

SEQ ID NO: 70 - protein, 13 aa, Artificial Sequence
  Made in a lab
SGSSSNIGGNAVN

SEQ ID NO: 71 - protein, 7 aa, Artificial Sequence
  Made in a lab
SSNHRPS

SEQ ID NO: 72 - protein, 11 aa, Artificial Sequence
  Made in a lab
AAWDDSLNGPL

SEQ ID NO: 73 - protein, 10 aa, Artificial Sequence
  Made in a lab
SGEKLGDRYA

SEQ ID NO: 74 - protein, 7 aa, Artificial Sequence
  Made in a lab
QDTKRPS

SEQ ID NO: 75 - protein, 11 aa, Artificial Sequence
  Made in a lab
AAWDDSLKGVV

SEQ ID NO: 76 - protein, 13 aa, Artificial Sequence
  Made in a lab
SGRSSNIGSNSVN

SEQ ID NO: 77 - protein, 7 aa, Artificial Sequence
  Made in a lab
SNNHRPS

SEQ ID NO: 78 - protein, 11 aa, Artificial Sequence
  Made in a lab
AAWDDSLYQGV

SEQ ID NO: 79 - protein, 11 aa, Artificial Sequence
  Made in a lab
RASQSISSYLN

SEQ ID NO: 80 - protein, 7 aa, Artificial Sequence
  Made in a lab
AASSLQS

SEQ ID NO: 81 - protein, 9 aa, Artificial Sequence
  Made in a lab
QQYEYFPPT

SEQ ID NO: 82 - protein, 12 aa, Artificial Sequence
  Made in a lab
RASQSVSSSYLA

SEQ ID NO: 83 - protein, 7 aa, Artificial Sequence
  Made in a lab
GASSRAT

SEQ ID NO: 84 - protein, 9 aa, Artificial Sequence
  Made in a lab
QQYGSSSLT

SEQ ID NO: 85 - protein, 11 aa, Artificial Sequence
  Made in a lab
RSSQRISGYLN

SEQ ID NO: 86 - protein, 7 aa, Artificial Sequence
  Made in a lab
AASTLQS

SEQ ID NO: 87 - protein, 9 aa, Artificial Sequence
  Made in a lab
QQSYSPPFT

SEQ ID NO: 88 - protein, 11 aa, Artificial Sequence
  Made in a lab
RASQSISTWLA

SEQ ID NO: 89 - protein, 7 aa, Artificial Sequence
  Made in a lab
KASSLQS

SEQ ID NO: 90 - protein, 9 aa, Artificial Sequence
  Made in a lab
QQYKSYPFT

SEQ ID NO: 91 - protein, 11 aa, Artificial Sequence
  Made in a lab
QASQDIRSYLN

SEQ ID NO: 92 - protein, 7 aa, Artificial Sequence
  Made in a lab
DTVNLQT

SEQ ID NO: 93 - protein, 9 aa, Artificial Sequence
  Made in a lab
QQYEYLPIT

SEQ ID NO: 94 - protein, 11 aa, Artificial Sequence
  Made in a lab
RASQSISNYLN

SEQ ID NO: 95 - protein, 8 aa, Artificial Sequence
  Made in a lab
YAASSLHS

SEQ ID NO: 96 - protein, 9 aa, Artificial Sequence
  Made in a lab
QQSYSTSGT

SEQ ID NO: 97 - protein, 11 aa, Artificial Sequence
  Made in a lab
RASQSISSYLN

SEQ ID NO: 98 - protein, 7 aa, Artificial Sequence
  Made in a lab
AASSLQS

SEQ ID NO: 99 - protein, 9 aa, Artificial Sequence
  Made in a lab
QQSYSTPVT

SEQ ID NO: 100 - protein, 11 aa, Artificial Sequence
  Made in a lab
RASQSIDTYLN

SEQ ID NO: 101 - protein, 7 aa, Artificial Sequence
  Made in a lab
AASSLQS

SEQ ID NO: 102 - protein, 10 aa, Artificial Sequence
  Made in a lab
QQSYSSPGIT

SEQ ID NO: 103 - protein, 11 aa, Artificial Sequence
  Made in a lab
RASQSIGTYLN

SEQ ID NO: 104 - protein, 7 aa, Artificial Sequence
  Made in a lab
GTSSLQR

SEQ ID NO: 105 - protein, 9 aa, Artificial Sequence
  Made in a lab
QQSYTSPPT

SEQ ID NO: 106 - protein, 11 aa, Artificial Sequence
  Made in a lab
SGDQLGGKFTS

SEQ ID NO: 107 - protein, 7 aa, Artificial Sequence
  Made in a lab
QDTKRPS

SEQ ID NO: 108 - protein, 9 aa, Artificial Sequence
  Made in a lab
LVWDSNTYV

SEQ ID NO: 109 - protein, 11 aa, Artificial Sequence
  Made in a lab
GGNNIGSKSVH

SEQ ID NO: 110 - protein, 7 aa, Artificial Sequence
  Made in a lab
DDSDRPS

SEQ ID NO: 111 - protein, 11 aa, Artificial Sequence
  Made in a lab
QVWDSSGGLQV

SEQ ID NO: 112 - protein, 11 aa, Artificial Sequence
  Made in a lab
RASQSISSWLA

SEQ ID NO: 113 - protein, 7 aa, Artificial Sequence
  Made in a lab
KASNLES

SEQ ID NO: 114 - protein, 9 aa, Artificial Sequence
  Made in a lab
QQYNAYPFI

SEQ ID NO: 115 - protein, 11 aa, Artificial Sequence
  Made in a lab
RASQSISSWLA

SEQ ID NO: 116 - protein, 7 aa, Artificial Sequence
  Made in a lab
KASSLES

SEQ ID NO: 117 - protein, 8 aa, Artificial Sequence
  Made in a lab
QQYKSYWT

SEQ ID NO: 118 - protein, 13 aa, Artificial Sequence
  Made in a lab
SGSPSNIGSNSVN

SEQ ID NO: 119 - protein, 7 aa, Artificial Sequence
  Made in a lab
YDDLVPS

SEQ ID NO: 120 - protein, 11 aa, Artificial Sequence
  Made in a lab
AAWDDRLNGWV

SEQ ID NO: 121 - protein, 11 aa, Artificial Sequence
  Made in a lab
RASQGISSWLA

SEQ ID NO: 122 - protein, 7 aa, Artificial Sequence
  Made in a lab
AASSLQS

SEQ ID NO: 123 - protein, 9 aa, Artificial Sequence
  Made in a lab
QQANSFPLT

SEQ ID NO: 124 - protein, 11 aa, Artificial Sequence
  Made in a lab
RASQSISSYLN

SEQ ID NO: 125 - protein, 7 aa, Artificial Sequence
  Made in a lab
AASSLQS

SEQ ID NO: 126 - protein, 9 aa, Artificial Sequence
  Made in a lab
QQSYSTPYT

SEQ ID NO: 127 - protein, 12 aa, Artificial Sequence
  Made in a lab
RASQSVSSSYLA

SEQ ID NO: 128 - protein, 7 aa, Artificial Sequence
  Made in a lab
GASNRVT

SEQ ID NO: 129 - protein, 8 aa, Artificial Sequence
  Made in a lab
HQYGSQYT

SEQ ID NO: 130 - protein, 11 aa, Artificial Sequence
  Made in a lab
QASQHISNFLN

SEQ ID NO: 131 - protein, 7 aa, Artificial Sequence
  Made in a lab
DTSNLRS

SEQ ID NO: 132 - protein, 9 aa, Artificial Sequence
  Made in a lab
QQYDNFPLT

SEQ ID NO: 133 - protein, 13 aa, Artificial Sequence
  Made in a lab
SGSTSNIGNNAVI

SEQ ID NO: 134 - protein, 7 aa, Artificial Sequence
  Made in a lab
YDDLLPS

SEQ ID NO: 135 - protein, 11 aa, Artificial Sequence
  Made in a lab
ASWDDNLNGPL

SEQ ID NO: 136 - protein, 11 aa, Artificial Sequence
  Made in a lab
RASQSISSWLA

SEQ ID NO: 137 - protein, 7 aa, Artificial Sequence
  Made in a lab
QASTLES

SEQ ID NO: 138 - protein, 9 aa, Artificial Sequence
  Made in a lab
QQANSFPIT

SEQ ID NO: 139 - protein, 11 aa, Artificial Sequence
  Made in a lab
QASQDITNYLN

SEQ ID NO: 140 - protein, 7 aa, Artificial Sequence
  Made in a lab
DASNLQT

SEQ ID NO: 141 - protein, 9 aa, Artificial Sequence
  Made in a lab
QQYDTLHPS

SEQ ID NO: 142 - protein, 14 aa, Artificial Sequence
  Made in a lab
TGTSSDVGVYDSVS

SEQ ID NO: 143 - protein, 7 aa, Artificial Sequence
  Made in a lab
DVSDRPS

SEQ ID NO: 144 - protein, 10 aa, Artificial Sequence
  Made in a lab
GSYRASSSYV

SEQ ID NO: 145 - protein, 11 aa, Artificial Sequence
  Made in a lab
RASQNIYHYLH

SEQ ID NO: 146 - protein, 7 aa, Artificial Sequence
  Made in a lab
AASTLES

SEQ ID NO: 147 - protein, 9 aa, Artificial Sequence
  Made in a lab
QQTYDTPLT

SEQ ID NO: 148 - protein, 11 aa, Artificial Sequence
  Made in a lab
SGDKLGEKFAS

SEQ ID NO: 149 - protein, 7 aa, Artificial Sequence
  Made in a lab
QDSKRPS

SEQ ID NO: 150 - protein, 10 aa, Artificial Sequence
  Made in a lab
QAWGGSTAYV

SEQ ID NO: 151 - protein, 11 aa, Artificial Sequence
  Made in a lab
RASQSVTTYLA

SEQ ID NO: 152 - protein, 7 aa, Artificial Sequence
  Made in a lab
DASNRAT

SEQ ID NO: 153 - protein, 11 aa, Artificial Sequence
  Made in a lab
QQRSNWPPSIT

SEQ ID NO: 154 - protein, 14 aa, Artificial Sequence
  Made in a lab
TGTSSDVGSYNLVS

SEQ ID NO: 155 - protein, 7 aa, Artificial Sequence
  Made in a lab
EGSKRPS

SEQ ID NO: 156 - protein, 10 aa, Artificial Sequence
  Made in a lab
CSYAGRSTYV

SEQ ID NO: 157 - protein, 11 aa, Artificial Sequence
  Made in a lab
SGNRLEDKYVH

SEQ ID NO: 158 - protein, 7 aa, Artificial Sequence
  Made in a lab
QDNKRPS

SEQ ID NO: 159 - protein, 10 aa, Artificial Sequence
  Made in a lab
QAWDSSTREV

SEQ ID NO: 160 - protein, 11 aa, Artificial Sequence
  Made in a lab
RASQGVSDWLA

SEQ ID NO: 161 - protein, 7 aa, Artificial Sequence
  Made in a lab
GASSLQT

SEQ ID NO: 162 - protein, 9 aa, Artificial Sequence
  Made in a lab
QQAHSFPFT

SEQ ID NO: 163 - protein, 11 aa, Artificial Sequence
  Made in a lab
RASQNINTHLA

SEQ ID NO: 164 - protein, 7 aa, Artificial Sequence
  Made in a lab
GASTRAT

SEQ ID NO: 165 - protein, 10 aa, Artificial Sequence
  Made in a lab
QQYGSSLTWT

SEQ ID NO: 166 - protein, 12 aa, Artificial Sequence
  Made in a lab
RASQSVSGNYLA

SEQ ID NO: 167 - protein, 7 aa, Artificial Sequence
  Made in a lab
GASSRAT

SEQ ID NO: 168 - protein, 9 aa, Artificial Sequence
  Made in a lab
LQHNSYPLT

SEQ ID NO: 169 - protein, 11 aa, Artificial Sequence
  Made in a lab
GGINIGSKSVH

SEQ ID NO: 170 - protein, 8 aa, Artificial Sequence
  Made in a lab
YFDSDRPS

SEQ ID NO: 171 - protein, 11 aa, Artificial Sequence
  Made in a lab
QVWDSRSDQYV

SEQ ID NO: 172 - protein, 11 aa, Artificial Sequence
  Made in a lab
RASQSISSWLA

SEQ ID NO: 173 - protein, 7 aa, Artificial Sequence
  Made in a lab
KASTLES

SEQ ID NO: 174 - protein, 9 aa, Artificial Sequence
  Made in a lab
QQYNSYSLT

SEQ ID NO: 175 - protein, 11 aa, Artificial Sequence
  Made in a lab
RASQSISSYLN

SEQ ID NO: 176 - protein, 7 aa, Artificial Sequence
  Made in a lab
AASSLQS

SEQ ID NO: 177 - protein, 9 aa, Artificial Sequence
  Made in a lab
QQSYSTPLT

SEQ ID NO: 178 - protein, 11 aa, Artificial Sequence
  Made in a lab
RASQSINNYLN

SEQ ID NO: 179 - protein, 7 aa, Artificial Sequence
  Made in a lab
TASTLHS

SEQ ID NO: 180 - protein, 9 aa, Artificial Sequence
  Made in a lab
QQSYATLRT

SEQ ID NO: 181 - protein, 14 aa, Artificial Sequence
  Made in a lab
SGSSSDVGHYDYVS

SEQ ID NO: 182 - protein, 7 aa, Artificial Sequence
  Made in a lab
DVSNRPS

SEQ ID NO: 183 - protein, 10 aa, Artificial Sequence
  Made in a lab
SSYTSSGTRV

SEQ ID NO: 184 - protein, 11 aa, Artificial Sequence
  Made in a lab
RASQSVNNWVA

SEQ ID NO: 185 - protein, 7 aa, Artificial Sequence
  Made in a lab
AASSLQS

SEQ ID NO: 186 - protein, 9 aa, Artificial Sequence
  Made in a lab
QQSYSMPLT

SEQ ID NO: 187 - protein, 5 aa, Artificial Sequence
  Made in a lab
KYSMH

SEQ ID NO: 188 - protein, 17 aa, Artificial Sequence
  Made in a lab
SIWPSGGWTTYADSVKG

SEQ ID NO: 189 - protein, 9 aa, Artificial Sequence
  Made in a lab
GGYYYALDY

SEQ ID NO: 190 - protein, 5 aa, Artificial Sequence
  Made in a lab
FYQMH

SEQ ID NO: 191 - protein, 17 aa, Artificial Sequence
  Made in a lab
GIYPSGGYTKYADSVKG

SEQ ID NO: 192 - protein, 13 aa, Artificial Sequence
  Made in a lab
DLGYGSSWYYFDY

SEQ ID NO: 193 - protein, 5 aa, Artificial Sequence
  Made in a lab
KYSMH

SEQ ID NO: 194 - protein, 16 aa, Artificial Sequence
  Made in a lab
GISPSGYTRYADSVKG

SEQ ID NO: 195 - protein, 9 aa, Artificial Sequence
  Made in a lab
DQLLEAFDI

SEQ ID NO: 196 - protein, 5 aa, Artificial Sequence
  Made in a lab
EYPMN

SEQ ID NO: 197 - protein, 17 aa, Artificial Sequence
  Made in a lab
GIYSSGGLTKYADSVKG

SEQ ID NO: 198 - protein, 10 aa, Artificial Sequence
  Made in a lab
DHYGDYAFDY

SEQ ID NO: 199 - protein, 5 aa, Artificial Sequence
  Made in a lab
LYEMV

SEQ ID NO: 200 - protein, 17 aa, Artificial Sequence
  Made in a lab
GIWPSGGWTQYADSVKG

SEQ ID NO: 201 - protein, 17 aa, Artificial Sequence
  Made in a lab
DLAVAGWDYYYYYGMDV

SEQ ID NO: 202 - protein, 5 aa, Artificial Sequence
  Made in a lab
QYNMI

SEQ ID NO: 203 - protein, 16 aa, Artificial Sequence
  Made in a lab
WISSSGGTEYADSVKG

SEQ ID NO: 204 - protein, 17 aa, Artificial Sequence
  Made in a lab
DRGYGSGSYGAYDAFDI

SEQ ID NO: 205 - protein, 5 aa, Artificial Sequence
  Made in a lab
HYSMG

SEQ ID NO: 206 - protein, 17 aa, Artificial Sequence
  Made in a lab
SIYPSGGSTLYADSVKG

SEQ ID NO: 207 - protein, 9 aa, Artificial Sequence
  Made in a lab
WGVGATFDY

SEQ ID NO: 208 - protein, 5 aa, Artificial Sequence
  Made in a lab
HYMMA

SEQ ID NO: 209 - protein, 17 aa, Artificial Sequence
  Made in a lab
YIYPSGGWTSYADSVKG

SEQ ID NO: 210 - protein, 9 aa, Artificial Sequence
  Made in a lab
FDYTIGFDF

SEQ ID NO: 211 - protein, 5 aa, Artificial Sequence
  Made in a lab
HYGMT

SEQ ID NO: 212 - protein, 17 aa, Artificial Sequence
  Made in a lab
GIRSSGGVTNYADSVKG

SEQ ID NO: 213 - protein, 11 aa, Artificial Sequence
  Made in a lab
EGSGWSKAFDI

SEQ ID NO: 214 - protein, 5 aa, Artificial Sequence
  Made in a lab
HYNMR

SEQ ID NO: 215 - protein, 17 aa, Artificial Sequence
  Made in a lab
SISPSGGFTGYADSVKG

SEQ ID NO: 216 - protein, 18 aa, Artificial Sequence
  Made in a lab
GINYYDSSGYYPPVGMDV

SEQ ID NO: 217 - protein, 5 aa, Artificial Sequence
  Made in a lab
WYNML

SEQ ID NO: 218 - protein, 17 aa, Artificial Sequence
  Made in a lab
SISPSGGYTVYADSVKG

SEQ ID NO: 219 - protein, 14 aa, Artificial Sequence
  Made in a lab
DRGGSPFRPDAFDI

SEQ ID NO: 220 - protein, 5 aa, Artificial Sequence
  Made in a lab
EYDML

SEQ ID NO: 221 - protein, 17 aa, Artificial Sequence
  Made in a lab
SIWPSGGFTQYADSVKG

SEQ ID NO: 222 - protein, 16 aa, Artificial Sequence
  Made in a lab
NYYDFWSGPYYYGMDV

SEQ ID NO: 223 - protein, 5 aa, Artificial Sequence
  Made in a lab
GYVMG

SEQ ID NO: 224 - protein, 17 aa, Artificial Sequence
  Made in a lab
SISPSGGYTLYADSVKG

SEQ ID NO: 225 - protein, 13 aa, Artificial Sequence
  Made in a lab
AFSTRWYWGAFDI

SEQ ID NO: 226 - protein, 5 aa, Artificial Sequence
  Made in a lab
IYHMN

SEQ ID NO: 227 - protein, 17 aa, Artificial Sequence
  Made in a lab
GISSSGGRTNYADSVKG

SEQ ID NO: 228 - protein, 16 aa, Artificial Sequence
  Made in a lab
SYRAAGWVDYYYGMDV

SEQ ID NO: 229 - protein, 5 aa, Artificial Sequence
  Made in a lab
LYDMH

SEQ ID NO: 230 - protein, 17 aa, Artificial Sequence
  Made in a lab
RIYSSGGTTQYADSVKG

SEQ ID NO: 231 - protein, 12 aa, Artificial Sequence
  Made in a lab
DPGYGSHHSFDY

SEQ ID NO: 232 - protein, 5 aa, Artificial Sequence
  Made in a lab
SYYMT

SEQ ID NO: 233 - protein, 17 aa, Artificial Sequence
  Made in a lab
GIYSSGGPTQYADSVKG

SEQ ID NO: 234 - protein, 8 aa, Artificial Sequence
  Made in a lab
AGGDAFDI

SEQ ID NO: 235 - protein, 5 aa, Artificial Sequence
  Made in a lab
SYEMF

SEQ ID NO: 236 - protein, 17 aa, Artificial Sequence
  Made in a lab
SISPSGGYTYYADSVKG

SEQ ID NO: 237 - protein, 9 aa, Artificial Sequence
  Made in a lab
MTTSGFHLI

SEQ ID NO: 238 - protein, 5 aa, Artificial Sequence
  Made in a lab
DYPMQ

SEQ ID NO: 239 - protein, 17 aa, Artificial Sequence
  Made in a lab
WIGPSGGWTVYADSVKG

SEQ ID NO: 240 - protein, 8 aa, Artificial Sequence
  Made in a lab
DDGIAGFL

SEQ ID NO: 241 - protein, 5 aa, Artificial Sequence
  Made in a lab
WYLMH

SEQ ID NO: 242 - protein, 17 aa, Artificial Sequence
  Made in a lab
GIWPSGGHTLYADSVKG

SEQ ID NO: 243 - protein, 16 aa, Artificial Sequence
  Made in a lab
EPLLWFGELSYNWFDP

SEQ ID NO: 244 - protein, 6 aa, Artificial Sequence
  Made in a lab
YYENMA

SEQ ID NO: 245 - protein, 17 aa, Artificial Sequence
  Made in a lab
GIYPSGGLTYYADSVKG

SEQ ID NO: 246 - protein, 13 aa, Artificial Sequence
  Made in a lab
SRRYYDSSDAFDI

SEQ ID NO: 247 - protein, 5 aa, Artificial Sequence
  Made in a lab
TYVMY

SEQ ID NO: 248 - protein, 17 aa, Artificial Sequence
  Made in a lab
GIGPSGGNTFYADSVKG

SEQ ID NO: 249 - protein, 14 aa, Artificial Sequence
  Made in a lab
DPGDFWSGYYGMDV

SEQ ID NO: 250 - protein, 5 aa, Artificial Sequence
  Made in a lab
FYGMA

SEQ ID NO: 251 - protein, 17 aa, Artificial Sequence
  Made in a lab
SIYPSGGYTDYADSVKG

SEQ ID NO: 252 - protein, 13 aa, Artificial Sequence
  Made in a lab
SAGGWIGGGAFDI

SEQ ID NO: 253 - protein, 5 aa, Artificial Sequence
  Made in a lab
KYPMM

SEQ ID NO: 254 - protein, 17 aa, Artificial Sequence
  Made in a lab
YIYPSGGKTAYADSVKG

SEQ ID NO: 255 - protein, 17 aa, Artificial Sequence
  Made in a lab
YGSGSYYLYYYYYYMDV

SEQ ID NO: 256 - protein, 5 aa, Artificial Sequence
  Made in a lab
WYSMW

SEQ ID NO: 257 - protein, 17 aa, Artificial Sequence
  Made in a lab
YIVPSGGETIYADSVKG

SEQ ID NO: 258 - protein, 16 aa, Artificial Sequence
  Made in a lab
NLGEGFWSDYYPPLDY

SEQ ID NO: 259 - protein, 5 aa, Artificial Sequence
  Made in a lab
HYGMH

SEQ ID NO: 260 - protein, 15 aa, Artificial Sequence
  Made in a lab
SIYPGMTQYADSVKG

SEQ ID NO: 261 - protein, 11 aa, Artificial Sequence
  Made in a lab
DRGSGIDAFDI

SEQ ID NO: 262 - protein, 5 aa, Artificial Sequence
  Made in a lab
WYDML

SEQ ID NO: 263 - protein, 17 aa, Artificial Sequence
  Made in a lab
VISPSGGRTFYADSVKG

SEQ ID NO: 264 - protein, 16 aa, Artificial Sequence
  Made in a lab
TRSMYSSSWYGAPPTH

SEQ ID NO: 265 - protein, 5 aa, Artificial Sequence
  Made in a lab
WYKMH

SEQ ID NO: 266 - protein, 17 aa, Artificial Sequence
  Made in a lab
GISSSGGLTKYADSVKG

SEQ ID NO: 267 - protein, 11 aa, Artificial Sequence
  Made in a lab
ERRGDGGAFDI

SEQ ID NO: 268 - protein, 5 aa, Artificial Sequence
  Made in a lab
EYTMY

SEQ ID NO: 269 - protein, 17 aa, Artificial Sequence
  Made in a lab
YISPSGGTTNYADSVKG

SEQ ID NO: 270 - protein, 13 aa, Artificial Sequence
  Made in a lab
GAWGDIYYYGMDV

SEQ ID NO: 271 - protein, 5 aa, Artificial Sequence
  Made in a lab
SYWMH

SEQ ID NO: 272 - protein, 17 aa, Artificial Sequence
  Made in a lab
SIYPSGGSTEYADSVKG

SEQ ID NO: 273 - protein, 6 aa, Artificial Sequence
  Made in a lab
GIWFDP

SEQ ID NO: 274 - protein, 5 aa, Artificial Sequence
  Made in a lab
RYGMM

SEQ ID NO: 275 - protein, 17 aa, Artificial Sequence
  Made in a lab
YISSSGGFTRYADSVKG

SEQ ID NO: 276 - protein, 12 aa, Artificial Sequence
  Made in a lab
VGGYSYGPHFDF

SEQ ID NO: 277 - protein, 5 aa, Artificial Sequence
  Made in a lab
WYHMI

SEQ ID NO: 278 - protein, 17 aa, Artificial Sequence
  Made in a lab
WISPSGGFTKYADSVKG

SEQ ID NO: 279 - protein, 14 aa, Artificial Sequence
  Made in a lab
YDSRAAAGTNAFDI

SEQ ID NO: 280 - protein, 5 aa, Artificial Sequence
  Made in a lab
PYKMV

SEQ ID NO: 281 - protein, 17 aa, Artificial Sequence
  Made in a lab
GISPSGGYTYYADSVKG

SEQ ID NO: 282 - protein, 14 aa, Artificial Sequence
  Made in a lab
GGYGWSYYYYGMDV

SEQ ID NO: 283 - protein, 5 aa, Artificial Sequence
  Made in a lab
NYWMY

SEQ ID NO: 284 - protein, 17 aa, Artificial Sequence
  Made in a lab
VISSSGGHTFYADSVKG

SEQ ID NO: 285 - protein, 9 aa, Artificial Sequence
  Made in a lab
DYEGGSNDY

SEQ ID NO: 286 - protein, 5 aa, Artificial Sequence
  Made in a lab
NYAMS

SEQ ID NO: 287 - protein, 17 aa, Artificial Sequence
  Made in a lab
SIYSSGGYTAYADSVKG

SEQ ID NO: 288 - protein, 11 aa, Artificial Sequence
  Made in a lab
VPHVFRGELDY

SEQ ID NO: 289 - protein, 5 aa, Artificial Sequence
  Made in a lab
FYTMW

SEQ ID NO: 290 - protein, 17 aa, Artificial Sequence
  Made in a lab
SIYPSGGQTLYADSVKG

SEQ ID NO: 291 - protein, 13 aa, Artificial Sequence
  Made in a lab
PDSYGYLYYGMDV

SEQ ID NO: 292 - protein, 5 aa, Artificial Sequence
  Made in a lab
WYPME

SEQ ID NO: 293 - protein, 17 aa, Artificial Sequence
  Made in a lab
GIGPSGGQTTYADSVKG

SEQ ID NO: 294 - protein, 6 aa, Artificial Sequence
  Made in a lab
GSYSFI

SEQ ID NO: 295 - protein, 5 aa, Artificial Sequence
  Made in a lab
LYKMA

SEQ ID NO: 296 - protein, 17 aa, Artificial Sequence
  Made in a lab
VIGSSGGRTPYADSVKG

SEQ ID NO: 297 - protein, 16 aa, Artificial Sequence
  Made in a lab
APLSGWFGQAHDAFDI

SEQ ID NO: 298 - protein, 5 aa, Artificial Sequence
  Made in a lab
TYEMN

SEQ ID NO: 299 - protein, 17 aa, Artificial Sequence
  Made in a lab
GIVPSGGVTYYADSVKG

SEQ ID NO: 300 - protein, 13 aa, Artificial Sequence
  Made in a lab
GPYSYGHDYGMDV

SEQ ID NO: 301 - protein, 5 aa, Artificial Sequence
  Made in a lab
VYPMH

SEQ ID NO: 302 - protein, 17 aa, Artificial Sequence
  Made in a lab
SIYSSGGFTMYADSVKG

SEQ ID NO: 303 - protein, 9 aa, Artificial Sequence
  Made in a lab
EGVADAFDI

SEQ ID NO: 304 - protein, 5 aa, Artificial Sequence
  Made in a lab
SYTMH

SEQ ID NO: 305 - protein, 17 aa, Artificial Sequence
  Made in a lab
SISPSGGMTFYADSVKG

SEQ ID NO: 306 - protein, 11 aa, Artificial Sequence
  Made in a lab
TYDFWSGYFDY

SEQ ID NO: 307 - protein, 5 aa, Artificial Sequence
  Made in a lab
TYEMG

SEQ ID NO: 308 - protein, 17 aa, Artificial Sequence
  Made in a lab
VIWSSGGHTWYADSVKG

SEQ ID NO: 309 - protein, 16 aa, Artificial Sequence
  Made in a lab
SNQGDFWSGYPFAFDI

SEQ ID NO: 310 - protein, 5 aa, Artificial Sequence
  Made in a lab
NYNMY

SEQ ID NO: 311 - protein, 17 aa, Artificial Sequence
  Made in a lab
YISPSGGMTKYADSVKG

SEQ ID NO: 312 - protein, 11 aa, Artificial Sequence
  Made in a lab
RGVLGYYGMDV

SEQ ID NO: 313 - protein, 5 aa, Artificial Sequence
  Made in a lab
LYSMN

SEQ ID NO: 314 - protein, 17 aa, Artificial Sequence
  Made in a lab
SISSSGGATLYADSVKG

SEQ ID NO: 315 - protein, 14 aa, Artificial Sequence
  Made in a lab
DLISSGYYPDAFDI

SEQ ID NO: 316 - protein, 5 aa, Artificial Sequence
  Made in a lab
QYMMH

SEQ ID NO: 317 - protein, 17 aa, Artificial Sequence
  Made in a lab
SISSSGGWTSYADSVKG

SEQ ID NO: 318 - protein, 19 aa, Artificial Sequence
  Made in a lab
PLALGYDFWSGYQAAGFDY

SEQ ID NO: 319 - protein, 5 aa, Artificial Sequence
  Made in a lab
WYSMV

SEQ ID NO: 320 - protein, 17 aa, Artificial Sequence
  Made in a lab
SIVPSGGLTWYADSVKG

SEQ ID NO: 321 - protein, 10 aa, Artificial Sequence
  Made in a lab
DVYGDYYFDN

SEQ ID NO: 322 - protein, 5 aa, Artificial Sequence
  Made in a lab
YYNMT

SEQ ID NO: 323 - protein, 17 aa, Artificial Sequence
  Made in a lab
SISPSGGRTGYADSVKG

SEQ ID NO: 324 - protein, 10 aa, Artificial Sequence
  Made in a lab
VSGFYAAFDY

SEQ ID NO: 325 - protein, 5 aa, Artificial Sequence
  Made in a lab
WYWMT

SEQ ID NO: 326 - protein, 17 aa, Artificial Sequence
  Made in a lab
SISPSGGHTSYADSVKG

SEQ ID NO: 327 - protein, 11 aa, Artificial Sequence
  Made in a lab
SSGWYEDYFDY

SEQ ID NO: 328 - protein, 5 aa, Artificial Sequence
  Made in a lab
PYEMA

SEQ ID NO: 329 - protein, 17 aa, Artificial Sequence
  Made in a lab
VIGPSGGYTEYADSVKG

SEQ ID NO: 330 - protein, 14 aa, Artificial Sequence
  Made in a lab
GYDFWSGYYDAFDI

SEQ ID NO: 331 - protein, 5 aa, Artificial Sequence
  Made in a lab
SYFMG

SEQ ID NO: 332 - protein, 17 aa, Artificial Sequence
  Made in a lab
SIWPSGGNTTYADSVKG

SEQ ID NO: 333 - protein, 10 aa, Artificial Sequence
  Made in a lab
HVGWGRYFDY

SEQ ID NO: 334 - protein, 5 aa, Artificial Sequence
  Made in a lab
AYRMI

SEQ ID NO: 335 - protein, 17 aa, Artificial Sequence
  Made in a lab
YISSSGGRTDYADSVKG

SEQ ID NO: 336 - protein, 15 aa, Artificial Sequence
  Made in a lab
GGLRYFDWLAPSMDY

SEQ ID NO: 337 - protein, 5 aa, Artificial Sequence
  Made in a lab
AYSMV

SEQ ID NO: 338 - protein, 17 aa, Artificial Sequence
  Made in a lab
YIYPSGGITTYADSVKG

SEQ ID NO: 339 - protein, 7 aa, Artificial Sequence
  Made in a lab
EGQVFDI

SEQ ID NO: 340 - protein, 5 aa, Artificial Sequence
  Made in a lab
NYAMG

SEQ ID NO: 341 - protein, 17 aa, Artificial Sequence
  Made in a lab
RIVPSGGMTSYADSVKG

SEQ ID NO: 342 - protein, 9 aa, Artificial Sequence
  Made in a lab
DDFWSGMDV

SEQ ID NO: 343 - protein, 5 aa, Artificial Sequence
  Made in a lab
LYNMQ

SEQ ID NO: 344 - protein, 17 aa, Artificial Sequence
  Made in a lab
GISLSGGKTFYADSVKG

SEQ ID NO: 345 - protein, 12 aa, Artificial Sequence
  Made in a lab
DYGVATLDAFDI

SEQ ID NO: 346 - protein, 5 aa, Artificial Sequence
  Made in a lab
AYTMH

SEQ ID NO: 347 - protein, 17 aa, Artificial Sequence
  Made in a lab
SIYPSGGTTPYADSVKG

SEQ ID NO: 348 - protein, 18 aa, Artificial Sequence
  Made in a lab
VVNIDFWSGYNMRSAFDI

SEQ ID NO: 349 - protein, 5 aa, Artificial Sequence
  Made in a lab
DYLMG

SEQ ID NO: 350 - protein, 17 aa, Artificial Sequence
  Made in a lab
VISSSGGPTAYADSVKG

SEQ ID NO: 351 - protein, 13 aa, Artificial Sequence
  Made in a lab
VGLDYGILGAFDI

SEQ ID NO: 352 - protein, 5 aa, Artificial Sequence
  Made in a lab
EYGMS

SEQ ID NO: 353 - protein, 17 aa, Artificial Sequence
  Made in a lab
SIRSSGGWTKYADSVKG

SEQ ID NO: 354 - protein, 11 aa, Artificial Sequence
  Made in a lab
GLGATSGEFDY

SEQ ID NO: 355 - protein, 5 aa, Artificial Sequence
  Made in a lab
KYDMW

SEQ ID NO: 356 - protein, 17 aa, Artificial Sequence
  Made in a lab
SIWPSGGWTSYADSVKG

SEQ ID NO: 357 - protein, 12 aa, Artificial Sequence
  Made in a lab
SRGSPWYGDFDH

SEQ ID NO: 358 - protein, 5 aa, Artificial Sequence
  Made in a lab
MYTMH

SEQ ID NO: 359 - protein, 17 aa, Artificial Sequence
  Made in a lab
WISPSGGWTKYADSVKG

SEQ ID NO: 360 - protein, 9 aa, Artificial Sequence
  Made in a lab
SPWGGPFDY

SEQ ID NO: 361 - protein, 5 aa, Artificial Sequence
  Made in a lab
QYFMM

SEQ ID NO: 362 - protein, 17 aa, Artificial Sequence
  Made in a lab
SISPSGGYTQYADSVKG

SEQ ID NO: 363 - protein, 14 aa, Artificial Sequence
  Made in a lab
TGDYTRYYSYGMDV

SEQ ID NO: 364 - protein, 5 aa, Artificial Sequence
  Made in a lab
GYSMA

SEQ ID NO: 365 - protein, 17 aa, Artificial Sequence
  Made in a lab
GIYSSGGWTWYADSVKG

SEQ ID NO: 366 - protein, 15 aa, Artificial Sequence
  Made in a lab
DQSFSYDSSLDAFDI

SEQ ID NO: 367 - protein, 5 aa, Artificial Sequence
  Made in a lab
LYGMH

SEQ ID NO: 368 - protein, 17 aa, Artificial Sequence
  Made in a lab
SIVPSGGLTRYADSVKG

SEQ ID NO: 369 - protein, 15 aa, Artificial Sequence
  Made in a lab
LAYYDFWSGRDAFDI

SEQ ID NO: 370 - protein, 5 aa, Artificial Sequence
  Made in a lab
HYGMD

SEQ ID NO: 371 - protein, 17 aa, Artificial Sequence
  Made in a lab
SIYSSGGYTLYADSVKG

SEQ ID NO: 372 - protein, 9 aa, Artificial Sequence
  Made in a lab
RTWADAFDV

SEQ ID NO: 373 - protein, 105 aa, Artificial Sequence
  Made in a lab
QSELTQPPSVSVSPGQTATITCSGEKLGDIYASWYQQKPGQSPVLVIYQDTKRPSGIPVRFSGSNSGNTATLTISGTQAMDEADYYCQAWDSSTVFGGGTKLTVL

SEQ ID NO: 374 - protein, 110 aa, Artificial Sequence
  Made in a lab
QSALTQPASVSGSPGQSITISCSGTDSDVGGYNHVSWYQQHPGKAPKLIIYDVDHRPSGISNRFSGSKSGNTASLTISGLQAEDEADYYCSSYRSGSTYVFGTATKVTVL

SEQ ID NO: 375 - protein, 108 aa, Artificial Sequence
  Made in a lab
QDIQMTQSPLSLSASVGDRVTITCRASQSISSYLNWYQQKPGEAPKLLIYAASALQSGVPSRFSGSGLGTVFTLTITSLQPEDSATYYCQQSYSPPVTFGGGTKVDIK

SEQ ID NO: 376 - protein, 107 aa, Artificial Sequence
  Made in a lab
QDIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 377 - protein, 109 aa, Artificial Sequence
  Made in a lab
QDIQMTQSPATLSLSPGERATLSCRASQSVSSYLAWYQQKPGQAPRLLIYDASNRATGIPARFSGSGSGTDFTLTISSLEPEDSAVYYCQQRSNWPPFTFGGGTKVEIK

SEQ ID NO: 378 - protein, 108 aa, Artificial Sequence
  Made in a lab
QDIQMTQSPSSLSASVGDRVTITCQTSQSIDRYLNWYQQKAGEAPKLLIYAASSLQSGVPSRFSGSGSGTDFTLTISSLQPEDFASYYCQQSYRTPRTFGQGTKVEIK

SEQ ID NO: 379 - protein, 110 aa, Artificial Sequence
  Made in a lab
QDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPLWTFGQGTKVEIK

SEQ ID NO: 380 - protein, 108 aa, Artificial Sequence
  Made in a lab
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 381 - protein, 110 aa, Artificial Sequence
  Made in a lab
QDIQMTQSPATLSLSPGERATLSCRASQSISTSLAWYQQIPGQAPRLLMYDASKRASGIPARFSGSGSGTDFTLTISSLEPEDSAVYYCQLRINWPPEFTFGPGTKVEIK

SEQ ID NO: 382 - protein, 108 aa, Artificial Sequence
  Made in a lab
QDIQMTQSPSSVSASVGDRVTITCRASRGVITWLNWYQQKPGRVPSPLIFGASTLQTGVPSRFSGSGSGTDFTLTINDLQPEDFATYYCQQTHSFPLTFGGGTKVEIK

SEQ ID NO: 383 - protein, 106 aa, Artificial Sequence
  Made in a lab
QSALTQPPSVSVSPGQTARITCSGDKLGEKYVSWYQQRSGQSPLLVISQDTKRPSGIPERFSGSNSGNTATLTISGAQAADEADYYCQTWDSDTYVFGSGSTVTVL

SEQ ID NO: 384 - protein, 108 aa, Artificial Sequence
  Made in a lab
QDIQMTQSPSSLSASVGDRVTITCRASQSISSYLNWYQQKPGKAPKLLIYAASSLQSGVPSRFSGSGSGTDFTLTISSLQPEDFATYYCQQSYSTLWTFGQGTKVEIK

SEQ ID NO: 385 - protein, 108 aa, Artificial Sequence
  Made in a lab
QDIQMTQSPATLSLSPGERATLSCRASQSVRSYLAWYQQKPGQAPRLLIYDASNRATGIPARFSGSGSGTDFTLTITSLQPEDIATYYCQQYDNLPLTFGGGTKVEIK

SEQ ID NO: 386 - protein, 108 aa, Artificial Sequence
  Made in a lab
QDIQMTQSPSSLSAFVGDRVTITCRTSQSVATYVNWYQQKPGEGPKLLIYAASSLQSGVPSRFRGSGSGTDFTLTIGSLQPEDFATYYCQQSYSVPITFGQGTRLDIK

SEQ ID NO: 387 - protein, 109 aa, Artificial Sequence
  Made in a lab
QDIQMTQSPSTLSASVGDRVTITCRASQSMSNWLAWYQQKPGKAPKLLIYDVFTLKSGVPSRFSGSRSGTEFTLTISSLQPDDFATYYCQQYSDYSGITFGPGTEVDIR

SEQ ID NO: 388 - protein, 111 aa, Artificial Sequence
  Made in a lab
QSVLTQPPSASGTPGQRVTISCSGSSSNIGSKVVYWYQQVPGTAPKLLIYRNDQRPSGVPDRFSGSKSGTSASLAISGLRSEDEADYYCAAWDDSLSGRWVFGGGTKLTVL

SEQ ID NO: 389 - protein, 108 aa, Artificial Sequence
  Made in a lab
QDIQMTQSPATLSASVGDRVTITCRASQSISSWLAWYQQKPGKAPKLLIYKASGLESGVPSRFSGSGSGTEFTLTISSLQPDDFATYYCQQYNSYPFTFGPGTKVDIK

SEQ ID NO: 390 - protein, 108 aa, Artificial Sequence
  Made in a lab
QDIQMTQSPLSLSASVGDRVTITCQASRDISIYLNWYQQKPGKVPKLLIFGASTLRSGVPSRFSGSGSGTDFTLTITSLQPEDVATYYCQKYNSAPYTFGPGTKVEIR

SEQ ID NO: 391 - protein, 108 aa, Artificial Sequence
  Made in a lab
QDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 392 - protein, 108 aa, Artificial Sequence
  Made in a lab
QDIQMTQSPATLSLSPGERATLSCRASQSINTYLAWYQQKPGHPPRLLIYDASNRATGIPDRFSGSGSGTDFTLTISRLEPEDFVVYYCQQYGRSRYTFGQGTKLEIK

SEQ ID NO: 393 - protein, 108 aa, Artificial Sequence
  Made in a lab
QDIQMTQSPSSLSASVGDRVTITCRASQGISNYLAWYQQKPGKVPKLLIYAASTLQSGVPSRFSGSGSGTEFTLTISSLQPEDFATYYCQQSDNIPYTFGLGTKLEIK

SEQ ID NO: 394 - protein, 110 aa, Artificial Sequence
  Made in a lab
QSELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGIGTKVTVL

SEQ ID NO: 395 - protein, 108 aa, Artificial Sequence
  Made in a lab
QDIQMTQSPSSLSASVGDSVTIACRASQSISTYLNWYQQKPGQAPKLLIYEATNLQSGVPSRFSGSGSGTDFTLTISSLQPEDVATYYCQQANNFPFTFGPGTKVDIK

SEQ ID NO: 396 - protein, 110 aa, Artificial Sequence
  Made in a lab
QSVLTQPPSASGTPGQRVTISCSGSSSNIGGNAVNWYQQLPGTAPKLVLYSSNHRPSGVPDRFSGSRSGTSASLAISGLQSQDEADYYCAAWDDSLNGPLFGGGTKLTVL

SEQ ID NO: 397 - protein, 108 aa, Artificial Sequence
  Made in a lab
QSELTQPPSVSVSPGQTATISCSGEKLGDRYAWWYQQKAGQSPVLVIYQDTKRPSGVPDRFSGSNSGTSASLVISGLQSEDEADYYCAAWDDSLKGVVFGGGSKLTVL

SEQ ID NO: 398 - protein, 110 aa, Artificial Sequence
  Made in a lab
QSELTQPPSASGTPGQRVTISCSGRSSNIGSNSVNWYQQLPGTAPKLLIYSNNHRPSGVPDRFSGSKSGTSASLAISGLQSEDEADYYCAAWDDSLYQGVFGGGTKLTVL

SEQ ID NO: 399 - protein, 108 aa, Artificial Sequence
  Made in a lab
QDIQMTQSPSSLSASVGDRVTITCRASQSISSYLNWYQQKPGKAPKLLIYAASSLQSGVPSKFSGSGSGTDFTLTISSLLPEDFATYYCQQYEYFPPTFGQGTKVEIK

SEQ ID NO: 400 - protein, 109 aa, Artificial Sequence
  Made in a lab
QDIQMTQSPDSLSLSPGERATLSCRASQSVSSSYLAWYQQKPGQAPRLLIYGASSRATGIPDRFSGSGSGTDFTLTISRLEPEDFAVYYCQQYGSSSLTFGGGTEVEIK

SEQ ID NO: 401 - protein, 108 aa, Artificial Sequence
  Made in a lab
QDIQMTQSPATLSASVGDRVTITCRSSQRISGYLNWYQQQPGKAPKLLIYAASTLQSGVPSRISGSGSGTDFSLIISSLQPEDVATYYCQQSYSPPFTFGQGTKVEIK

SEQ ID NO: 402 - protein, 108 aa, Artificial Sequence
  Made in a lab
QDIQMTQSPSTLSASVGDRVTITCRASQSISTWLAWFQQKPGKAPKLLIYKASSLQSGVPSRFSGSGSGTDFTLTISSLQPEDFATYYCQQYKSYPFTFGGGTKVEIK

SEQ ID NO: 403 - protein, 108 aa, Artificial Sequence
  Made in a lab
QDIQMTQSPSSLSASVGDSVTITCQASQDIRSYLNWFQQKPGKAPKLLIYDTVNLQTGVPSRFSGSGSGTDYSFTINNLQPEDFATYYCQQYEYLPITFGQGTRLEIK

SEQ ID NO: 404 - protein, 108 aa, Artificial Sequence
  Made in a lab
QDIQMTQSPSSLSASVGDRVTITCRASQSISNYLNWYQQKSGKAPNLLMYAASSLHSGVSSRFSGSGSGTEFTLTISSLQPEDYATYYCQQSYSTSGTFGQGTKVEIK

SEQ ID NO: 405 - protein, 108 aa, Artificial Sequence
  Made in a lab
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPVTFGGGTKVEIK

SEQ ID NO: 406 - protein, 109 aa, Artificial Sequence
  Made in a lab
QDIQMTQSPSSLSASVGDRVAITCRASQSIDTYLNWYQHKPGKAPKLLIYAASSLQSGVPSRFSGSGSGTDFTLTISGLQPEDFASYFCQQSYSSPGITFGGGTRVEIK

SEQ ID NO: 407 - protein, 108 aa, Artificial Sequence
  Made in a lab
QDIQMTQSPSSLSASVGDRVTITCRASQSIGTYLNWYQQKPGKAPNLLIYGTSSLQRGVPSRFSGSGSGTDFTLTISTLQPEDFVHYYCQQSYTSPPTFGQGTKVEVK

SEQ ID NO: 408 - protein, 106 aa, Artificial Sequence
  Made in a lab
QYELTQSPSVSVSPGQTASIPCSGDQLGGKFTSWYQQKAGQSPLLVIYQDTKRPSGIPERFSGSNSGNTATLTITGTQAMDEADYYCLVWDSNTYVFGPGTKVTVL

SEQ ID NO: 409 - protein, 108 aa, Artificial Sequence
  Made in a lab
QYELTQPPSVSVAPGQTARITCGGNNIGSKSVHWYQQKPGQAPVLVVYDDSDRPSGIPERFSGSNSGNTATLTVSRVEAGDEADYYCQVWDSSGGLQVFGTGTKVTVL

SEQ ID NO: 410 - protein, 108 aa, Artificial Sequence
  Made in a lab
QDIQMTQSPSTLSASVGDRVTITCRASQSISSWLAWYQQKPGKAPKLLIYKASNLESEVPSRFSGSGSGTEFTLTISSLQPDDFATYYCQQYNAYPFIFGPGTKVDIK

SEQ ID NO: 411 - protein, 107 aa, Artificial Sequence
  Made in a lab
QDIQMTQSPSTLSASVGDRVTITCRASQSISSWLAWYQQKPGKAPKLLIYKASSLESGVPSRFSGSGSGTEFTLTISSLQPDDFATYHCQQYKSYWTFGQGTKVEIK

SEQ ID NO: 412 - protein, 110 aa, Artificial Sequence
  Made in a lab
QSELTQPPSVSEAPRQRVTVSCSGSPSNIGSNSVNWYQQLPGKAPKVVIYYDDLVPSGVSDRFSGSKSGTSASLAISGLQSEDEADYYCAAWDDRLNGWVFGGGTKLTVL

SEQ ID NO: 413 - protein, 108 aa, Artificial Sequence; identical to SEQ ID NO: 391
  Made in a lab

SEQ ID NO: 414 - protein, 108 aa, Artificial Sequence
  Made in a lab
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 415 - protein, 108 aa, Artificial Sequence
  Made in a lab
QDIQMTQSPGTLSLSPGERATLSCRASQSVSSSYLAWYQQKPGQAPRLLIYGASNRVTGIPDRFSGSGSGTDFTLTISRLEPEDSAVYYCHQYGSQYTFGPGTKLEIK

SEQ ID NO: 416 - protein, 108 aa, Artificial Sequence
  Made in a lab
QDIQMTQSPSSLSASVGDRVTISCQASQHISNFLNWYQQKPGKAPKLLIYDTSNLRSGVPSRFSGSGSGTDFTFTISSLQPEDIATYYCQQYDNFPLTFGGGTKVEIK

SEQ ID NO: 417 - protein, 110 aa, Artificial Sequence
  Made in a lab
QSELTQPPSVSEAPGQRVTISCSGSTSNIGNNAVIWYQQLPGKAPKLLIYYDDLLPSGVSDRFSGSKSGTSGSLAISGLQSEDEADYYCASWDDNLNGPLFGGGTKLTVL

SEQ ID NO: 418 - protein, 108 aa, Artificial Sequence
  Made in a lab
QDIQMTQSPSTLSASVGDRVTITCRASQSISSWLAWYQQKPGKAPKLLIYQASTLESGVPSRFSGSGSGTDFTLTISSLQPEDFATYYCQQANSFPITFGGGTKVEIN

SEQ ID NO: 419 - protein, 108 aa, Artificial Sequence
  Made in a lab
QDIQMTQSPSSLSASVGDRVTITCQASQDITNYLNWYLHKPGKAPKLLIYDASNLQTGVPSRFSGSGSGTDFTFTITSLQPEDFGTYYCQQYDTLHPSFGPGTTVDIK

SEQ ID NO: 420 - protein, 110 aa, Artificial Sequence
  Made in a lab
QSALTQPPSASGSPGQSVTISCTGTSSDVGVYDSVSWYQQHPGKAPKLMIYDVSDRPSGVSNRFSGSKSGYTASLTISALQAEDEADYYCGSYRASSSYVFGTGTKVTVL

SEQ ID NO: 421 - protein, 108 aa, Artificial Sequence
  Made in a lab
QDIQMTQSPSSLSASVGDRVTITCRASQNIYHYLHWYQQKPGKAPKLLIYAASTLESGVPSRFSGSGSGTDFTLTINSLQPEDFATYYCQQTYDTPLTFGGGSKVEVK

SEQ ID NO: 422 - protein, 107 aa, Artificial Sequence
  Made in a lab
QSALTQPPSVSVSPGQTASITCSGDKLGEKFASWYQQRPGQSPILVIYQDSKRPSGIPERFSGSNSGNTATLTISGTQTMDEADYYCQAWGGSTAYVFGSGTKVTVL

SEQ ID NO: 423 - protein, 110 aa, Artificial Sequence
  Made in a lab
QDIQMTQSPATLSLSPGERATLSCRASQSVTTYLAWYQQRPGQAPRLLIYDASNRATGIPARFSGSGSGTDFTLTISSVEPEDYAVYYCQQRSNWPPSITFGQGTRLESK

SEQ ID NO: 424 - protein, 110 aa, Artificial Sequence
  Made in a lab
QSALTQPASVSGSPGQSITISCTGTSSDVGSYNLVSWYQQHPGKAPKVMIYEGSKRPSGVSNRFSGSKSGNTASLTISGLQAEDEADYYCCSYAGRSTYVFGTGTKVTVL

SEQ ID NO: 425 - protein, 107 aa, Artificial Sequence
  Made in a lab
QSELTQTPSVSVSPGQTASITCSGNRLEDKYVHWYQQKPGQSPVLVLYQDNKRPSGIPERFSGSNSGNTATLTISETQTLDEADYYCQAWDSSTREVFGGGTKLTVL

SEQ ID NO: 426 - protein, 108 aa, Artificial Sequence
  Made in a lab
QDIQMTQSPSSVSASVGDTVTITCRASQGVSDWLAWYQQKPGKAPNLLIYGASSLQTGVPSRFSGGGSGTDFTLTISSLQPEDFATYYCQQAHSFPFTFGGGTRVEIK

SEQ ID NO: 427 - protein, 109 aa, Artificial Sequence
  Made in a lab
QDIQMTQSPATLSVSPGERATLSCRASQNINTHLAWYQQKPGQAPRLLIFGASTRATGIPARFSGSGSGTEFTLTISSLQSEDFTVYYCQQYGSSLTWTFGQGTKVEIK

SEQ ID NO: 428 - protein, 109 aa, Artificial Sequence
  Made in a lab
QDIQMTQSPGTLSLSPGERATLSCRASQSVSGNYLAWYQQKLGQAPRLLIYGASSRATGTPDRFSGSGSGTEFTLTISSLQPEDFATYYCLQHNSYPLTSGSGTEFTLT

SEQ ID NO: 429 - protein, 108 aa, Artificial Sequence
  Made in a lab
QSELTQPPSVSVAPGETATVTCGGINIGSKSVHWYQQKPGQAPVVVMYFDSDRPSGIPERFSGSNSGDTATLTISRVEAGDEADYYCQVWDSRSDQYVFGFGTKVTVL

SEQ ID NO: 430 - protein, 108 aa, Artificial Sequence
  Made in a lab
QDIQMTQSPSTLSASVGDRVTITCRASQSISSWLAWYQQKPGKAPKLLIYKASTLESGVPSRFSAGGSGTEFTLTISSLQPDDFGTYYCQQYNSYSLTFGGGTKVEII

SEQ ID NO: 431 - protein, 108 aa, Artificial Sequence
  Made in a lab
QDIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIK

SEQ ID NO: 432 - protein, 108 aa, Artificial Sequence
  Made in a lab
QDIQMTQSPSSLSASVGDRVTITCRASQSINNYLNWYQQKPGKAPKLLIYTASTLHSGVPSRFSGSGSGTDFTLTISNLQPEDFATYYCQQSYATLRTFGQGTKVEIK

SEQ ID NO: 433 - protein, 110 aa, Artificial Sequence
  Made in a lab
QSVLTQPASVSGSPGQSITISCSGSSSDVGHYDYVSWYQQHPGKAPKLMIYDVSNRPSGVSNRFSGSKSGNTASLTISGLQADDEAEYYCSSYTSSGTRVFGTGTKVTVL

SEQ ID NO: 434 - protein, 108 aa, Artificial Sequence
  Made in a lab
QDIQMTQSPSTLSASVGDRVTFTCRASQSVNNWVAWYQQKPGKAPKLLIYAASSLQSGVPSRFSGSGSGTDFTLTISSLQPEDFATYYCQQSYSMPLTFGGGTKVEIK

SEQ ID NO: 435 - protein, 118 aa, Artificial Sequence
  Made in a lab
EVQLLESGGGLVQPGGSLRLSCAASGFTFSKYSMHWVRQAPGKGLEWVSSIWPSGGWTTYADSVKGRFTISRDNSKNTLYLQMNSLRAEDTAVYYCARGGYYYALDYWGQGNLVTVSS

SEQ ID NO: 436 - protein, 122 aa, Artificial Sequence
  Made in a lab
EVQLLESGGGLVQPGGSLRLSCAASGFTFSFYQMHWVRQAPGKGLEWVSGIYPSGGYTKYADSVKGRFTISRDNSKNTLYLQMNSLRAEDTAVYYCARDLGYGSSWYYFDYWGQGTLVTVSS

SEQ ID NO: 437 - protein, 117 aa, Artificial Sequence
  Made in a lab
EVQLLESGGGLVQPGGSLRLSCAASGFTFSKYSMHWVRQAPGKGLEWVSGISPSGYTRYADSVKGRFTISRDNSKNTLYLQMNSLRAEDTAVYYCARDQLLEAFDIWGQGTTVTVSS

SEQ ID NO: 438 - protein, 119 aa, Artificial Sequence
  Made in a lab
EVQLLESGGGLVQPGGSLRLSCAASGFTFSEYPMNWVRQAPGKGLEWVSGIYSSGGLTKYADSVKGRFTISRDNSKNTLYLQMNSLRAEDTAVYYCARDHYGDYAFDYWGQGTLVTVSS

SEQ ID NO: 439 - protein, 126 aa, Artificial Sequence
  Made in a lab
EVQLLESGGGLVQPGGSLRLSCAASGFTFSLYEMVWVRQAPGKGLEWVSGIWPSGGWTQYADSVKGRFTISRDNSKNTLYLQMNSLRAEDTAVYYCARDLAVAGWDYYYYYGMDVWGQGTTVTVSS

SEQ ID NO: 440 - protein, 125 aa, Artificial Sequence
  Made in a lab
EVQLLESGGGLVQPGGSLRLSCAASGFTFSQYNMIWVRQAPGKGLEWVSWISSSGGTEYADSVKGRFTISRDNSKNTLYLQMNSLRAEDTAVYYCAKDRGYGSGSYGAYDAFDIWGQGKMVTVSS

SEQ ID NO: 441 - protein, 118 aa, Artificial Sequence
  Made in a lab
EVQLLESGGGLVQPGGSLRLSCAASGFTFSHYSMGWVRQAPGKGLEWVSSIYPSGGSTLYADSVKGRFTISRDNSKNTLYLQMNSLRAEDTAVYYCARWGVGATFDYWGQGTLVTVSS

SEQ ID NO: 442 - protein, 118 aa, Artificial Sequence
  Made in a lab
EVQLLESGGGLVQPGGSLRLSCAASGFTFSHYMMAWVRQAPGKGLEWVSYIYPSGGWTSYADSVKGRFTISRDNSKNTLYLQMNSLRAEDTAVYYCARFDYTIGFDFWGQGTLVTVSS

SEQ ID NO: 443 - protein, 120 aa, Artificial Sequence
  Made in a lab
EVQLLESGGGLVQPGGSLRLSCAASGFTFSHYGMTWVRQAPGKGLEWVSGIRSSGGVTNYADSVKGRFTISRDNSKNTLYLQMNSLRAEDTAVYYCAREGSGWSKAFDIWGQGTMVTVSS

SEQ ID NO: 444 - protein, 127 aa, Artificial Sequence
  Made in a lab
EVQLLESGGGLVQPGGSLRLSCAASGFTFSHYNMRWVRQAPGKGLEWVSSISPSGGFTGYADSVKGRFTISRDNSKNTLYLQMNSLRAEDTAVYYCARGINYYDSSGYYPPVGMDVWGQGTTVTVSS

SEQ ID NO: 445 - protein, 123 aa, Artificial Sequence
  Made in a lab
EVQLLESGGGLVQPGGSLRLSCAASGFTFSWYNMLWVRQAPGKGLEWVSSISPSGGYTVYADSVKGRFTISRDNSKNTLYLQMNSLRAEDTAVYYCARDRGGSPFRPDAFDIWGQGTMVTVSS

SEQ ID NO: 446 - protein, 125 aa, Artificial Sequence
  Made in a lab
EVQLLESGGGLVQPGGSLRLSCAASGFTFSEYDMLWVRQAPGKGLEWVSSIWPSGGFTQYADSVKGRFTISRDNSKNTLYLQMNSLRAEDTAVYYCARNYYDFWSGPYYYGMDVWGQGTTVTVSS

SEQ ID NO: 447 - protein, 122 aa, Artificial Sequence
  Made in a lab
EVQLLESGGGLVQPGGSLRLSCAASGFTFSGYVMGWVRQAPGKGLEWVSSISPSGGYTLYADSVKGRFTISRDNSKNTLYLQMNSLRAEDTAVYYCARAFSTRWYWGAFDIWGQGTMVTVSS

SEQ ID NO: 448 - protein, 125 aa, Artificial Sequence
  Made in a lab
EVQLLESGGGLVQPGGSLRLSCAASGFTFSIYHMNWVRQAPGKGLEWVSGISSSGGRTNYADSVKGRFTISRDNSKNTLYLQMNSLRAEDTAVYYCASSYRAAGWVDYYYGMDVWGQGTTVTVSS

SEQ ID NO: 449 - protein, 121 aa, Artificial Sequence
  Made in a lab
EVQLLESGGGLVQPGGSLRLSCAASGFTFSLYDMHWVRQAPGKGLEWVSRIYSSGGTTQYADSVKGRFTISRDNSKNTLYLQMNSLRAEDTAMYYCARDPGYGSHHSFDYWGQGTLVTVSS

SEQ ID NO: 450 - protein, 117 aa, Artificial Sequence
  Made in a lab
EVQLLESGGGLVQPGGSLRLSCAASGFTFSSYYMTWVRQAPGKGLEWVSGIYSSGGPTQYADSVKGRFTISRDNSKNTLYLQMNSLRAEDTAVYYCARAGGDAFDIWGQGTMVTVSS

SEQ ID NO: 451 - protein, 118 aa, Artificial Sequence
  Made in a lab
EVQLLESGGGLVQPGGSLRLSCAASGFTFSSYEMFWVRQAPGKGLEWVSSISPSGGYTYYADSVKGRFTISRDNSKNTLYLQMNSLRAEDTAVYYCATMTTSGFHLIWGQGTMVTVSS

SEQ ID NO: 452 - protein, 117 aa, Artificial Sequence
  Made in a lab
EVQLLESGGGLVQPGGSLRLSCAASGFTFSDYPMQWVRQAPGKGLEWVSWIGPSGGWTVYADSVKGRFTISRDNSKNTLYLQMNSLRAEDTAVYYCARDDGIAGFLWGQGTLVTVSS

SEQ ID NO: 453 - protein, 125 aa, Artificial Sequence
  Made in a lab
EVQLLESGGGLVQPGGSLRLSCAASGFTFSWYLMHWVRQAPGKGLEWVSGIWPSGGHTLYADSVKGRFTISRDNSKNTLYLQMNSLRAEDTAVYYCAREPLLWFGELSYNWFDPWGQGTLVTVSS

SEQ ID NO: 454 - protein, 123 aa, Artificial Sequence
  Made in a lab
EVQLLESGGGLVQPGGSLRLSCAASGFTFSYYENMAWVRQAPGKGLEWVSGIYPSGGLTYYADSVKGRFTISRDNSKNTLYLQMNSLRAEDTAVYYCARSRRYYDSSDAFDIWGQGTMVTVSS

SEQ ID NO: 455 - protein, 123 aa, Artificial Sequence
  Made in a lab
EVQLLESGGGLVQPGGSLRLSCAASGFTFSTYVMYWVRQAPGKGLEWVSGIGPSGGNTFYADSVKGRFTISRDNSKNTLYLQMNSLRAEDTAVYYCARDPGDFWSGYYGMDVWGQGTTVTVSS

SEQ ID NO: 456 - protein, 122 aa, Artificial Sequence
  Made in a lab
EVQLLESGGGLVQPGGSLRLSCAASGFTFSFYGMAWVRQAPGKGLEWVSSIYPSGGYTDYADSVKGRFTISRDNSKNTLYLQMNSLRAEDTAVYYCARSAGGWIGGGAFDIWGQGTMVTVSS

SEQ ID NO: 457 - protein, 126 aa, Artificial Sequence
  Made in a lab
EVQLLESGGGLVQPGGSLRLSCAASGFTFSKYPMMWVRQAPGKGLEWVSYIYPSGGKTAYADSVKGRFTISRDNSKNTLYLQMNSLRAEDTAVYYCATYGSGSYYLYYYYYYMDVWGKGTTVTVSS

SEQ ID NO: 458 - protein, 125 aa, Artificial Sequence
  Made in a lab
EVQLLESGGGLVQPGGSLRLSCAASGFTFSWYSMWWVRQAPGKGLEWVSYIVPSGGETIYADSVKGRFTISRDNSKNTLYLQMNSLRAEDTAVYYCAKNLGEGFWSDYYPPLDYWGQGTLVTVSS

SEQ ID NO: 459 - protein, 118 aa, Artificial Sequence
  Made in a lab
EVQLLESGGGLVQPGGSLRLSCAASGFTFSHYGMHWVRQAPGKGLEWVSSIYPGMTQYADSVKGRFTISRDNSKNTLYLQMNSLRAEDTAVYYCARDRGSGIDAFDIWGQGTMVTVSS

SEQ ID NO: 460 - protein, 125 aa, Artificial Sequence
  Made in a lab
EVQLLESGGGLVQPGGSLRLSCAASGFTFSWYDMLWVRQAPGKGLEWVSVISPSGGRTFYADSVKGRFTISRDNSKNTLYLQMNSLRAEDTAVYYCAVTRSMYSSSWYGAPPTHWGQGTLVTVSS

SEQ ID NO: 461 - protein, 120 aa, Artificial Sequence
  Made in a lab
EVQLLESGGGLVQPGGSLRLSCAASGFTFSWYKMHWVRQAPGKGLEWVSGISSSGGLTKYADSVKGRFTISRDNSKNTLYLQMNSLRAEDTAVYYCTTERRGDGGAFDIWGQGTMVTVSS

SEQ ID NO: 462 - protein, 122 aa, Artificial Sequence
  Made in a lab
EVQLLESGGGLVQPGGSLRLSCAASGFTFSEYTMYWVRQAPGKGLEWVSYISPSGGTTNYADSVKGRFTISRDNSKNTLYLQMNSLRAEDTAVYYCAKGAWGDIYYYGMDVWGQGTTVTVSS

SEQ ID NO: 463 - protein, 115 aa, Artificial Sequence
  Made in a lab
EVQLLESGGGLVQPGGSLRLSCAASGFTFSSYWMHWVRQAPGKGLEWVSSIYPSGGSTEYADSVKGRFTISRDNSKNTLYLQMNSLRAEDTAVYYCAKGIWFDPWGQGTLVTVSS

SEQ ID NO: 464 - protein, 121 aa, Artificial Sequence
  Made in a lab
EVQLLESGGGLVQPGGSLRLSCAASGFTFSRYGMMWVRQAPGKGLEWVSYISSSGGFTRYADSVKGRFTISRDNSKNTLYLQMNSLRAEDTAVYYCARVGGYSYGPHFDFWGQGTLVTVSS

SEQ ID NO: 465 - protein, 123 aa, Artificial Sequence
  Made in a lab
EVQLLESGGGLVQPGGSLRLSCAASGFTFSWYHMIWVRQAPGKGLEWVSWISPSGGFTKYADSVKGRFTISRDNSKNTLYLQMNSLRAEDTAVYYCARYDSRAAAGTNAFDIWGQGTMVTVSS

SEQ ID NO: 466 - protein, 123 aa, Artificial Sequence
  Made in a lab
EVQLLESGGGLVQPGGSLRLSCAASGFTFSPYKMVWVRQAPGKGLEWVSGISPSGGYTYYADSVKGRFTISRDNSKNTLYLQMNSLRAEDTAVYYCARGGYGWSYYYYGMDVWGQGTTVTVSS

SEQ ID NO: 467 - protein, 118 aa, Artificial Sequence
  Made in a lab
EVQLLESGGGLVQPGGSLRLSCAASGFTFSNYWMYWVRQAPGKGLEWVSVISSSGGHTFYADSVKGRFTISRDNSKNTLYLQMNSLRAEDTAVYYCARDYEGGSNDYWGQGTLVTVSS

SEQ ID NO: 468 - protein, 120 aa, Artificial Sequence
  Made in a lab
EVQLLESGGGLVQPGGSLRLSCAASGFTFSNYAMSWVRQAPGKGLEWVSSIYSSGGYTAYADSVKGRFTISRDNSKNTLYLQMNSLRAEDTAMYYCARVPHVFRGELDYWGQGTLVTVSS

SEQ ID NO: 469 - protein, 122 aa, Artificial Sequence
  Made in a lab
EVQLLESGGGLVQPGGSLRLSCAASGFTFSFYTMWWVRQAPGKGLEWVSSIYPSGGQTLYADSVKGRFTISRDNSKNTLYLQMNSLRAEDTAVYYCARPDSYGYLYYGMDVWGQGTTVTVSS

SEQ ID NO: 470 - protein, 115 aa, Artificial Sequence
  Made in a lab
EVQLLESGGGLVQPGGSLRLSCAASGFTFSWYPMEWVRQAPGKGLEWVSGIGPSGGQTTYADSVKGRFTISRDNSKNTLYLQMNSLRAEDTAVYYCARGSYSFIWGQGTMVTVSS

SEQ ID NO: 471 - protein, 125 aa, Artificial Sequence
  Made in a lab
EVQLLESGGGLVQPGGSLRLSCAASGFTFSLYKMAWVRQAPGKGLEWVSVIGSSGGRTPYADSVKGRFTISRDNSKNTLYLQMNSLRAEDTAVYYCARAPLSGWFGQAHDAFDIWGQGTMVTVSS

SEQ ID NO: 472 - protein, 122 aa, Artificial Sequence
  Made in a lab
EVQLLESGGGLVQPGGSLRLSCAASGFTFSTYEMNWVRQAPGKGLEWVSGIVPSGGVTYYADSVKGRFTISRDNSKNTLYLQMNSLRAEDTAVYYCARGPYSYGHDYGMDVWGQGTTVTVSS

SEQ ID NO: 473 - protein, 112 aa, Artificial Sequence
  Made in a lab
EVQLLESGGGLVQPGGSLRLSCAASGFTFSVYPMHWVRQAPGKGLEWVSSIYSSGGFTMYADSVKGRFTISRDNSKNTLYLQMNSLRAEDTAEGVADAFDIWGQGTMVTVSS

SEQ ID NO: 474 - protein, 120 aa, Artificial Sequence
  Made in a lab
EVQLLESGGGLVQPGGSLRLSCAASGFTFSSYTMHWVRQAPGKGLEWVSSISPSGGMTFYADSVKGRFTISRDNSKNTLYLQMNSLRAEDTAVYYCARTYDFWSGYFDYWGQGTLVTVSS

SEQ ID NO: 475 - protein, 125 aa, Artificial Sequence
  Made in a lab
EVQLLESGGGLVQPGGSLRLSCAASGFTFSTYEMGWVRQAPGKGLEWVSVIWSSGGHTWYADSVKGRFTISRDNSKNTLYLQMNSLRAEDTAVYYCARSNQGDFWSGYPFAFDIWGQGTMVTVSS

SEQ ID NO: 476 - protein, 120 aa, Artificial Sequence
  Made in a lab
EVQLLESGGGLVQPGGSLRLSCAASGFTFSNYNMYWVRQAPGKGLEWVSYISPSGGMTKYADSVKGRFTISRDNSKNTLYLQMNSLRAEDTAVYYCARRGVLGYYGMDVWGQGTTVTVSS

SEQ ID NO: 477 - protein, 123 aa, Artificial Sequence
  Made in a lab
EVQLLESGGGLVQPGGSLRLSCAASGFTFSLYSMNWVRQAPGKGLEWVSSISSSGGATLYADSVKGRFTISRDNSKNTLYLQMNSLRAEDTAVYYCARDLISSGYYPDAFDIWGQGTMVTVSS

SEQ ID NO: 478 - protein, 128 aa, Artificial Sequence
  Made in a lab
EVQLLESGGGLVQPGGSLRLSCAASGFTFSQYMMHWVRQAPGKGLEWVSSISSSGGWTSYADSVKGSFTISRDNSKNTLYLQMNSLRAEDTAVYYCARPLALGYDFWSGYQAAGFDYWGQGTLVTVSS

SEQ ID NO: 479 - protein, 119 aa, Artificial Sequence
  Made in a lab
EVQLLESGGGLVQPGGSLRLSCAASGFTFSWYSMVWVRQAPGKGLEWVSSIVPSGGLTWYADSVKGRFTISRDNSKNTLYLQMNSLRAEDTAVYYCARDVYGDYYFDNWGQGTLVTVSS

SEQ ID NO: 480 - protein, 119 aa, Artificial Sequence
  Made in a lab
EVQLLESGGGLVQPGGSLRLSCAASGFTFSYYNMTWVRQAPGKGLEWVSSISPSGGRTGYADSVKGRFTISRDNSKNTLYLQMNSLRAEDTAVYYCARVSGFYAAFDYWGQGTLVTVSS

SEQ ID NO: 481 - protein, 120 aa, Artificial Sequence
  Made in a lab
EVQLLESGGGLVQPGGSLRLSCAASGFTFSWYWMTWVRQAPGKGLEWVSSISPSGGHTSYADSVKGRFTISRDNSKNTLYLQMNSLRAEDTAVYYCAKSSGWYEDYFDYWGQGTLVTVSS

SEQ ID NO: 482 - protein, 123 aa, Artificial Sequence
  Made in a lab
EVQLLESGGGLVQPGGSLRLSCAASGFTFSPYEMAWVRQAPGKGLEWVSVIGPSGGYTEYADSVKGRFTISRDNSKNTLYLQMNSLRAEDTAVYYCARGYDFWSGYYDAFDIWGQGTMVTVSS

SEQ ID NO: 483 - protein, 119 aa, Artificial Sequence
  Made in a lab
EVQLLESGGGLVQPGGSLRLSCAASGFTFSSYFMGWVRQAPGKGLEWVSSIWPSGGNTTYADSVKGRFTISRDNSKNTLYLQMNSLRAEDTAVYYCARHVGWGRYFDYWGQGTLVTVSS

SEQ ID NO: 484 - protein, 124 aa, Artificial Sequence
  Made in a lab
EVQLLESGGGLVQPGGSLRLSCAASGFTFSAYRMIWVRQAPGKGLEWVSYISSSGGRTDYADSVKGRFTISRDNSKNTLYLQMNSLRAEDTAVYYCTTGGLRYFDWLAPSMDYWGQGTLVTVSS

SEQ ID NO: 485 - protein, 116 aa, Artificial Sequence
  Made in a lab
EVQLLESGGGLVQPGGSLRLSCAASGFTFSAYSMVWVRQAPGKGLEWVSYIYPSGGITTYADSVKGRFTISRDNSKNTLYLQMNSLRAEDTAVYYCAREGQVFDIWGQGTTVTVSS

SEQ ID NO: 486 - protein, 118 aa, Artificial Sequence
  Made in a lab
EVQLLESGGGLVQPGGSLRLSCAASGFTFSNYAMGWVRQAPGKGLEWVSRIVPSGGMTSYADSVKGRFTISRDNSKNTLYLQMNSLRAEDTAVYYCTTDDFWSGMDVWGQGTTVTVSS

SEQ ID NO: 487 - protein, 121 aa, Artificial Sequence
  Made in a lab
EVQLLESGGGLVQPGGSLRLSCAASGFTFSLYNMQWVRQAPGKGLEWVSGISLSGGKTFYADSVKGRFTISRDNSKNTLYLQMNSLRAEDTAVYYCARDYGVATLDAFDIWGQGTMVTVSS

SEQ ID NO: 488 - protein, 127 aa, Artificial Sequence
  Made in a lab
EVQLLESGGGLVQPGGSLRLSCAASGFTFSAYTMHWVRQAPGKGLEWVSSIYPSGGTTPYADSVKGRFTISRDNSKNTLYLQMNSLRAEDTATYYCARVVNIDFWSGYNMRSAFDIWGQGTMVTVSS

SEQ ID NO: 489 - protein, 122 aa, Artificial Sequence
  Made in a lab
EVQLLESGGGLVQPGGSLRLSCAASGFTFSDYLMGWVRQAPGKGLEWVSVISSSGGPTAYADSVKGRFTISRDNSKNTLYLQMNSLRAEDTAVYYCARVGLDYGILGAFDIWGQGTMVTVSS

SEQ ID NO: 490 - protein, 120 aa, Artificial Sequence
  Made in a lab
EVQLLESGGGLVQPGGSLRLSCAASGFTFSEYGMSWVRQAPGKGLEWVSSIRSSGGWTKYADSVKGRFTISRDNSKNTLYLQMNSLRAEDTAVYYCAKGLGATSGEFDYWGQGTLVTVSS

SEQ ID NO: 491 - protein, 121 aa, Artificial Sequence
  Made in a lab
EVQLLESGGGLVQPGGSLRLSCAASGFTFSKYDMWWVRQAPGKGLEWVSSIWPSGGWTSYADSVKGRFTISRDNSKNTLYLQMNSLRAEDTAVYYCAKSRGSPWYGDFDHWGQGTLVTVSS

SEQ ID NO: 492 - protein, 118 aa, Artificial Sequence
  Made in a lab
EVQLLESGGGLVQPGGSLRLSCAASGFTFSMYTMHWVRQAPGKGLEWVSWISPSGGWTKYADSVKGRFTISRDNSKNTLYLQMNSLRAEDTAVYYCAVSPWGGPFDYWGQGTLVTVSS

SEQ ID NO: 493 - protein, 123 aa, Artificial Sequence
  Made in a lab
EVQLLESGGGLVQPGGSLRLSCAASGFTFSQYFMMWVRQAPGKGLEWVSSISPSGGYTQYADSVKGRFTISRDNSKNTLYLQMNSLRAEDTAVYYCAKTGDYTRYYSYGMDVWGQGTLVTVSS

SEQ ID NO: 494 - protein, 124 aa, Artificial Sequence
  Made in a lab
EVQLLESGGGLVQPGGSLRLSCAASGFTFSGYSMAWVRQAPGKGLEWVSGIYSSGGWTWYADSVKGRFTISRDNSKNTLYLQMNSLRAEDTAVYYCTRDQSFSYDSSLDAFDIWGQGTMVTVSS

SEQ ID NO: 495 - protein, 124 aa, Artificial Sequence
  Made in a lab
EVQLLESGGGLVQPGGSLRLSCAASGFTFSLYGMHWVRQAPGKGLEWVSSIVPSGGLTRYADSVKGRFTISRDNSKNTLYLQMNSLRAEDTATYYCARLAYYDFWSGRDAFDIWGQGTMVTVSS

SEQ ID NO: 496 - protein, 118 aa, Artificial Sequence
  Made in a lab
EVQLLESGGGLVQPGGSLRLSCAASGFTFSHYGMDWVRQAPGKGLEWVSSIYSSGGYTLYADSVKGRFTISRDNSKNTLYLQMNSLRAEDTATYYCATRTWADAFDVWGQGTTVTVSS

SEQ ID NO: 497 - protein, 2 aa, Artificial Sequence
  Made in a lab
NS

SEQ ID NO: 498 - protein, 6 aa, Artificial Sequence
  Made in a lab
SCPPCP

SEQ ID NO: 499 - protein, 8 aa, Artificial Sequence
  Made in a lab
GGGGSGNS

SEQ ID NO: 500 - protein, 8 aa, Artificial Sequence
  Made in a lab
GCPPCPNS

SEQ ID NO: 501 - protein, 8 aa, Artificial Sequence
  Made in a lab
GSPPSPNS

SEQ ID NO: 502 - protein, 8 aa, Artificial Sequence
  Made in a lab
GSPPSPNS

SEQ ID NO: 503 - protein, 8 aa, Artificial Sequence
  Made in a lab
GCPPCPNS

SEQ ID NO: 504 - protein, 8 aa, Artificial Sequence
  Made in a lab
GCPPCPNS

SEQ ID NO: 505 - protein, 9 aa, Artificial Sequence
  Made in a lab
GCPPCPGNS

SEQ ID NO: 506 - protein, 9 aa, Artificial Sequence
  Made in a lab
GCPPCPANS

SEQ ID NO: 507 - protein, 9 aa, Artificial Sequence
  Made in a lab
GCPPCPANS

SEQ ID NO: 508 - protein, 9 aa, Artificial Sequence
  Made in a lab
EEEEDEGNS

SEQ ID NO: 509 - protein, 10 aa, Artificial Sequence
  Made in a lab
NYGGGGSGNS

SEQ ID NO: 510 - protein, 10 aa, Artificial Sequence
  Made in a lab
VSERPFPPNS

SEQ ID NO: 511 - protein, 11 aa, Artificial Sequence
  Made in a lab
EPKSCDKTCCP

SEQ ID NO: 512 - protein, 11 aa, Artificial Sequence
  Made in a lab
SQPEIVPISNS

SEQ ID NO: 513 - protein, 12 aa, Artificial Sequence
  Made in a lab
GGGGSCPPCPNS

SEQ ID NO: 514 - protein, 12 aa, Artificial Sequence
  Made in a lab
KADFLTPSIGNS

SEQ ID NO: 515 - protein, 12 aa, Artificial Sequence
  Made in a lab
QMNSELSVLANS

SEQ ID NO: 516 - protein, 13 aa, Artificial Sequence
  Made in a lab
EPKSCDKTHTCCP

SEQ ID NO: 517 - protein, 13 aa, Artificial Sequence
  Made in a lab
EPKSCDKTCPPCP

SEQ ID NO: 518 - protein, 13 aa, Artificial Sequence
  Made in a lab
GGGGSGGGGSGNS

SEQ ID NO: 519 - protein, 13 aa, Artificial Sequence
  Made in a lab
GCPPCPGGGGSNS

SEQ ID NO: 520 - protein, 13 aa, Artificial Sequence
  Made in a lab
GGGGSCPPCPGNS

SEQ ID NO: 521 - protein, 13 aa, Artificial Sequence
  Made in a lab
GCPPCPGGGGSNS

SEQ ID NO: 522 - protein, 13 aa, Artificial Sequence
  Made in a lab
GGGASCPPCPGNS

SEQ ID NO: 523 - protein, 13 aa, Artificial Sequence
  Made in a lab
GGGASCPPCAGNS

SEQ ID NO: 524 - protein, 13 aa, Artificial Sequence
  Made in a lab
GGGASCPPCAGNS

SEQ ID NO: 525 - protein, 15 aa, Artificial Sequence
  Made in a lab
NYGGGGSGGGGSGNS

SEQ ID NO: 526 - protein, 15 aa, Artificial Sequence
  Made in a lab
LSVKADFLTPSIGNS

SEQ ID NO: 527 - protein, 15 aa, Artificial Sequence
  Made in a lab
LSVLANFSQPEIGNS

SEQ ID NO: 528 - protein, 15 aa, Artificial Sequence
  Made in a lab
LKIQERVSKPKISNS

SEQ ID NO: 529 - protein, 15 aa, Artificial Sequence
  Made in a lab
LDVSERPFPPHIQNS

SEQ ID NO: 530 - protein, 15 aa, Artificial Sequence
  Made in a lab
REQLAEVTLSLKANS

SEQ ID NO: 531 - protein, 15 aa, Artificial Sequence
  Made in a lab
RIHQMNSELSVLANS

SEQ ID NO: 532 - protein, 15 aa, Artificial Sequence
  Made in a lab
DTKGKNVLEKIFSNS

SEQ ID NO: 533 - protein, 15 aa, Artificial Sequence
  Made in a lab
LPPETQESQEVTLNS

SEQ ID NO: 534 - protein, 15 aa, Artificial Sequence
  Made in a lab
RIHLNVSERPFPPNS

SEQ ID NO: 535 - protein, 15 aa, Artificial Sequence
  Made in a lab
LSVKADFLTPSIGNS

SEQ ID NO: 536 - protein, 15 aa, Artificial Sequence
  Made in a lab
LSVLANFSQPEIGNS

SEQ ID NO: 537 - protein, 15 aa, Artificial Sequence
  Made in a lab
LSVLANFSQPEIGNS

SEQ ID NO: 538 - protein, 15 aa, Artificial Sequence
  Made in a lab
RIHQMNSELSVLANS

SEQ ID NO: 539 - protein, 15 aa, Artificial Sequence
  Made in a lab
KPFFTCGSADTCPNS

SEQ ID NO: 540 - protein, 15 aa, Artificial Sequence
  Made in a lab
KPFFTCGSADTCPNS

SEQ ID NO: 541 - protein, 15 aa, Artificial Sequence
  Made in a lab
QYNCPGQYTFSMPNS

SEQ ID NO: 542 - protein, 15 aa, Artificial Sequence
  Made in a lab
GGGGSGGGGSGGGGS

SEQ ID NO: 543 - protein, 15 aa, Artificial Sequence
  Made in a lab
EPKSSDKTHTCPPCP

SEQ ID NO: 544 - protein, 15 aa, Artificial Sequence
  Made in a lab
EPKSSDKTHTCPPCS

SEQ ID NO: 545 - protein, 15 aa, Artificial Sequence
  Made in a lab
EPKSCDKTHTSPPCS

SEQ ID NO: 546 - protein, 15 aa, Artificial Sequence
  Made in a lab
EPKSCDKTHTCPPCP

SEQ ID NO: 547 - protein, 15 aa, Artificial Sequence
  Made in a lab
EPKSCDKTHTSPPSS

SEQ ID NO: 548 - protein, 15 aa, Artificial Sequence
  Made in a lab
PRGPTIKPCPPCKCP

SEQ ID NO: 549 - protein, 15 aa, Artificial Sequence
  Made in a lab
EPKSSDKTHTSPPSS

SEQ ID NO: 550 - protein, 15 aa, Artificial Sequence
  Made in a lab
EPKSSDKTHTSPPCS

SEQ ID NO: 551 - protein, 15 aa, Artificial Sequence
  Made in a lab
EPKSSDKTHTCPPSS

SEQ ID NO: 552 - protein, 15 aa, Artificial Sequence
  Made in a lab
EPKSCDKTHTSPPCP

SEQ ID NO: 553 - protein, 15 aa, Artificial Sequence
  Made in a lab
EPKSSDKTHTSPPSP

SEQ ID NO: 554 - protein, 15 aa, Artificial Sequence
  Made in a lab
EPKSSDKTHTSPPCP

SEQ ID NO: 555 - protein, 15 aa, Artificial Sequence
  Made in a lab
EPKSCDKTHTSPPSP

SEQ ID NO: 556 - protein, 15 aa, Artificial Sequence
  Made in a lab
EPKSSDKTHTCPPSP

SEQ ID NO: 557 - protein, 15 aa, Artificial Sequence
  Made in a lab
GGGGCDKTHTCPPCP

SEQ ID NO: 558 - protein, 15 aa, Artificial Sequence
  Made in a lab
EPKSCGGGGGCPPCP

SEQ ID NO: 559 - protein, 15 aa, Artificial Sequence
  Made in a lab
EPKSCDKTHTCGGCP

SEQ ID NO: 560 - protein, 15 aa, Artificial Sequence
  Made in a lab
EPKSCDKTHTCPPCG

SEQ ID NO: 561 - protein, 15 aa, Artificial Sequence
  Made in a lab
EPKSCDKTHTCPPSP

SEQ ID NO: 562 - protein, 15 aa, Artificial Sequence
  Made in a lab
EPKSCDKCHTCPPCP

SEQ ID NO: 563 - protein, 15 aa, Artificial Sequence
  Made in a lab
EPKSCDKTCCCPPCP

SEQ ID NO: 564 - protein, 15 aa, Artificial Sequence
  Made in a lab
EPKSCPPPPPCPPCP

SEQ ID NO: 565 - protein, 15 aa, Artificial Sequence
  Made in a lab
PPPPCDKTHTCPPCP

SEQ ID NO: 566 - protein, 15 aa, Artificial Sequence
  Made in a lab
EPKSCDKTHTCWWCP

SEQ ID NO: 567 - protein, 15 aa, Artificial Sequence
  Made in a lab
EPKSCDWWHTCPPCP

SEQ ID NO: 568 - protein, 15 aa, Artificial Sequence
  Made in a lab
EPKCSDKTHTCPPCP

SEQ ID NO: 569 - protein, 15 aa, Artificial Sequence
  Made in a lab
EPKSDCKTHTCPPCP

SEQ ID NO: 570 - protein, 15 aa, Artificial Sequence
  Made in a lab
EPKSDCWWHTCPPCP

SEQ ID NO: 571 - protein, 15 aa, Artificial Sequence
  Made in a lab
EPKSCDFFHTCPPCP

SEQ ID NO: 572 - protein, 15 aa, Artificial Sequence
  Made in a lab
EPKSCDWWWTCPPCP

SEQ ID NO: 573 - protein, 15 aa, Artificial Sequence
  Made in a lab
EPKSCWWTHTCPPCP

SEQ ID NO: 574 - protein, 15 aa, Artificial Sequence
  Made in a lab
EPWWCDKTHTCPPCP

SEQ ID NO: 575 - protein, 16 aa, Artificial Sequence
  Made in a lab
SQPEIVPISCPPCPNS

SEQ ID NO: 576 - protein, 17 aa, Artificial Sequence
  Made in a lab
TGEPKSSDKTHTCPPCP

SEQ ID NO: 577 - protein, 17 aa, Artificial Sequence
  Made in a lab
EPKSTDKTHTCPPCPNS

SEQ ID NO: 578 - protein, 17 aa, Artificial Sequence
  Made in a lab
EPKSTDKTHTSPPSPNS

SEQ ID NO: 579 - protein, 17 aa, Artificial Sequence
  Made in a lab
EPKSTDKTHTCPPCPNS

SEQ ID NO: 580 - protein, 17 aa, Artificial Sequence
  Made in a lab
EPKSSDKTHTCPPCPNS

SEQ ID NO: 581 - protein, 18 aa, Artificial Sequence
  Made in a lab
EPKSCDKTHTCPGGGPCP

SEQ ID NO: 582 - protein, 18 aa, Artificial Sequence
  Made in a lab
EPKSCDGGGKTHTCPPCP

SEQ ID NO: 583 - protein, 18 aa, Artificial Sequence
  Made in a lab
EPKSCDPPPKTHTCPPCP

SEQ ID NO: 584 - protein, 18 aa, Artificial Sequence
  Made in a lab
EPKSCDKTHTCPPPPPCP

SEQ ID NO: 585 - protein, 18 aa, Artificial Sequence
  Made in a lab
GGGGSGGGGSGGGGSGNS

SEQ ID NO: 586 - protein, 19 aa, Artificial Sequence
  Made in a lab
NYGGGGSGGGGSGGGGSNS

SEQ ID NO: 587 - protein, 19 aa, Artificial Sequence
  Made in a lab
LSVKADFLTPSISPPCPNS

SEQ ID NO: 588 - protein, 19 aa, Artificial Sequence
  Made in a lab
SVLANFSQPEISCPPCPNS

SEQ ID NO: 589 - protein, 20 aa, Artificial Sequence
  Made in a lab
GQRHNNSSLNTRTQKARHSP

SEQ ID NO: 590 - protein, 20 aa, Artificial Sequence
  Made in a lab
LSVLANFSQPEISCPPCPNS

SEQ ID NO: 591 - protein, 20 aa, Artificial Sequence
  Made in a lab
LKIQERVSKPKISCPPCPNS

SEQ ID NO: 592 - protein, 20 aa, Artificial Sequence
  Made in a lab
REQLAEVTLSLKACPPCPNS

SEQ ID NO: 593 - protein, 20 aa, Artificial Sequence
  Made in a lab
RIHQMNSELSVLACPPCPNS

SEQ ID NO: 594 - protein, 20 aa, Artificial Sequence
  Made in a lab
RIHLNVSERPFPPCPPCPNS

SEQ ID NO: 595 - protein, 20 aa, Artificial Sequence
  Made in a lab
NSLFNQEVQIPLTESYCPNS

SEQ ID NO: 596 - protein, 20 aa, Artificial Sequence
  Made in a lab
EEEEDEEDEEDEEEEEDGNS

SEQ ID NO: 597 - protein, 21 aa, Artificial Sequence
  Made in a lab
LDVSERPFPPHIQSCPPCPNS

SEQ ID NO: 598 - protein, 21 aa, Artificial Sequence
  Made in a lab
DTKGKNVLEKIFDSCPPCPNS

SEQ ID NO: 599 - protein, 21 aa, Artificial Sequence
  Made in a lab
LPPETQESQEVTLSCPPCPNS

SEQ ID NO: 600 - protein, 21 aa, Artificial Sequence
  Made in a lab
EPAFTPGPNIELQKDSDCPNS

SEQ ID NO: 601 - protein, 21 aa, Artificial Sequence
  Made in a lab
QRHNNSSLNTRTQKARHCPNS

SEQ ID NO: 602 - protein, 21 aa, Artificial Sequence
  Made in a lab
QRHNNSSLNTRTQKARHSPNS

SEQ ID NO: 603 - protein, 36 aa, Artificial Sequence
  Made in a lab
NYGGGGSGGGGSGGGGSNYGGGGSGGGGSGGGGSNS

SEQ ID NO: 604 - protein, 122 aa, Artificial Sequence
  Made in a lab
RTRYLQVSQQLQQTNRVLEVTNSSLRQQLRLKITQLGQSAEDLQGSRRELAQSQEALQVEQRAHQAAEGQLQACQADRQKTKETLQSEEQQRRALEQKLSNMENRLKPFFTCGSADTCCPNS

SEQ ID NO: 605 - DNA, 1971 bp, Artificial Sequence
  Made in a lab
aagcttgccgccatggattttcaagtgcagattttcagcttcctgctaatcagtgcttcagtcataattgccagaggagtcgaccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctggaggcggatctgatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatggatcagcccagagggcccacaatcaagccctgtcctccatgcaaatgcccggctccaaatcttcttggtggttcatccgtcttcatcttccctccaaagatcaaggatgtactcatgatctccctgagccccatagtcacatgtgtggtggtggatgtgagcgaggacgacccagatgtccagatcagctggtttgtgaacaacgtggaagtacacacagctcagacacaaacccatagagaggattacaacagtactctccgggtggtcagtgccctccccatccagcaccaggactggatgagtggcaaggagttcaaatgcaaggtcaacaacaaagacctcccagcgcccatcgagagaaccatctcaaaacccaaagggtcagtaagagctccacaggtatatgtcttgcctccaccagaagaagagatgactaagaaacaggtcactctgacctgcatggtcacagacttcatgcctgaagacatttacgtggagtggactaacaacgggaaaacagagctaaactacaagaacactgaaccagtcctggactctgatggttcttacttcatgtacagcaagctgagagtggaaaagaagaactgggtggaaagaaatagctactcctgttcagtggtccacgagggtctgcacaatcaccacacgactaagagcttctcccggactccgggtaaatgattctagagcggccgc

SEQ ID NO: 606 - protein, 647 aa, Artificial Sequence
  Made in a lab
MDFQVQIFSFLLISASVIIARGVDPEEPQLSCFRKSPLSNVVCEWGPRSTPSLTTKAVLLVRKFQNSPAEDFQEPCQYSQESQKFSCQLAVPEGDSSFYIVSMCVASSVGSKFSKTQTFQGCGILQPDPPANITVTAVARNPRWLSVTWQDPHSWNSSFYRLRFELRYRAERSKTFTTWMVKDLQHHCVIHDAWSGLRHVVQLRAQEEFGQGEWSEWSPEAMGTPWTESRSPPAGGGSDVAAPHRQPLTSSERIDKQIRYILDGISALRKETCNKSNMCESSKEALAENNLNLPKMAEKDGCFQSGFNEETCLVKIITGLLEFEVYLEYLQNRFESSEEQARAVQMSTKVLIQFLQKKAKNLDAITTPDPTTNASLLTKLQAQNQWLQDMTTHLILRSFKEFLQSSLRALRQMDQPRGPTIKPCPPCKCPAPNLLGGSSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSRTPGK

SEQ ID NO: 607 - protein, 749 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSKYSMHWVRQAPGKGLEWVSSIWPSGGWTTYADSVKGRFTISRDNSKNTLYLQMNSLRAEDTAVYYCARGGYYYALDYWGQGTLVTVSSGGGGSGGGGSGGGGSQSELTQPPSVSVSPGQTATITCSGEKLGDIYASWYQQKPGQSPVLVIYQDTKRPSGIPVRFSGSNSGNTATLTISGTQAMDEADYYCQAWDSSTVFGGGTKLTVL

SEQ ID NO: 608 - protein, 758 aa, Artificial Sequence [sequence omitted]

SEQ ID NO: 609 - protein, 751 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSKYSMHWVRQAPGKGLEWVSGISPSGYTRYADSVKGRFTISRDNSKNTLYLQMNSLRAEDTAVYYCARDQLLEAFDIWGQGTTVTVSSGGGGSGGGGSGGGGSQDIQMTQSPLSLSASVGDRVTITCRASQSISSYLNWYQQKPGEAPKLLIYAASALQSGVPSRFSGSGLGTVFTLTITSLQPEDSATYYCQQSYSPPVTFGGGTKVEIK

SEQ ID NO: 610 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSEYPMNWVRQAPGKGLEWVSGIYSSGGLTKYADSVKGRFTISRDNSKNTLYLQMNSLRAEDTAVYYCARDHYGDYAFDYWGQGTLVTVSSGGGGSGGGGSGGGGSQDIQMTQSPSTLSASVGDRVTITCRASQSISSWLAWYQQKPGKAPKLLIYKASSLESGVPSRFSGSGSGTEFTLTISSLQPDDFATYYCQQYNSYWTFGQGTKVEIK

SEQ ID NO: 611 - protein, 761 aa, Artificial Sequence [sequence omitted]

SEQ ID NO: 612 - protein, 759 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSQYNMIWVRQAPGKGLEWVSWISSSGGTEYADSVKGRFTISRDNSKNTLYLQMNSLRAEDTAVYYCAKDRGYGSGSYGAYDAFDIWGQGTMVTVSSGGGGSGGGGSGGGGSQDIQMTQSPSSLSASVGDRVTITCQTSQSIDRYLNWYQQKAGEAPKLLIYAASSLQSGVPSRFSGSGSGTDFTLTISSLQPEDFASYYCQQSYRTPRTFGQGTKVEIK

SEQ ID NO: 613 - protein, 754 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYSMGWVRQAPGKGLEWVSSIYPSGGSTLYADSVKGRFTISRDNSKNTLYLQMNSLRAEDTAVYYCARWGVGATFDYWGQGTLVTVSSGGGGSGGGGSGGGGSQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPLWTFGQGTKVEIK

SEQ ID NO: 614 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYMMAWVRQAPGKGLEWVSYIYPSGGWTSYADSVKGRFTISRDNSKNTLYLQMNSLRAEDTAVYYCARFDYTIGFDFWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIK

SEQ ID NO: 615 - protein, 756 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYGMTWVRQAPGKGLEWVSGIRSSGGVTNYADSVKGRFTISRDNSKNTLYLQMNSLRAEDTAVYYCAREGSGWSKAFDIWGQGTMVTVSSGGGGSGGGGSGGGGSQDIQMTQSPATLSLSPGERATLSCRASQSISTSLAWYQQIPGQAPRLLMYDASKRASGIPARFSGSGSGTDLTLTISSLEPEDSAVYYCQLRINWPPEFTFGPGTKVDIK

SEQ ID NO: 616 - protein, 761 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYNMRWVRQAPGKGLEWVSSISPSGGFTGYADSVKGRFTISRDNSKNTLYLQMNSLRAEDTAVYYCARGINYYDSSGYYPPVGMDVWGQGTTVTVSSGGGGSGGGGSGGGGSQDIQMTQSPSSVSASVGDRVTITCRASRGVITWLNWYQQKPGRVPSPLIFGASTLQTGVPSRFSGSGSGTDFTLTINDLQPEDFATYYCQQTHSFPLTFGGGTKVEIK

SEQ ID NO: 617 - protein, 755 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYNMLWVRQAPGKGLEWVSSISPSGGYTVYADSVKGRFTISRDNSKNTLYLQMNSLRAEDTAVYYCARDRGGSPFRPDAFDIWGQGTMVTVSSGGGGSGGGGSGGGGSQSALTQPPSVSVSPGQTARITCSGDKLGEKYVSWYQQRSGQSPLLVISQDTKRPSGIPERFSGSNSGNTATLTISGAQAADEADYYCQTWDSDTYVFGSGSTVTVL

SEQ ID NO: 618 - protein, 759 aa, Artificial Sequence [sequence omitted]

SEQ ID NO: 619 - protein, 756 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSGYVMGWVRQAPGKGLEWVSSISPSGGYTLYADSVKGRFTISRDNSKNTLYLQMNSLRAEDTAVYYCARAFSTRWYWGAFDIWGQGTMVTVSSGGGGSGGGGSGGGGSQDIQMTQSPATLSLSPGERATLSCRASQSVRSYLAWYQQKPGQAPRLLIYDASNRATGIPARFSGSGSGTDFTLTITSLQPEDIATYYCQQYDNLPLTFGGGTKVEIK

SEQ ID NO: 620 - protein, 759 aa, Artificial Sequence [sequence omitted]

SEQ ID NO: 621 - protein, 756 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSLYDMHWVRQAPGKGLEWVSRIYSSGGTTQYADSVKGRFTISRDNSKNTLYLQMNSLRAEDTAMYYCARDPGYGSHHSFDYWGQGTLVTVSSGGGGSGGGGSGGGGSQDIQMTQSPSTLSASVGDRVTITCRASQSMSNWLAWYQQKPGKAPKLLIYDVFTLKSGVPSRFSGSRSGTEFTLTISSLQPDDFATYYCQQYSDYSGITFGPGTEVDIR

SEQ ID NO: 622 - protein, 754 aa, Artificial Sequence [sequence omitted]

SEQ ID NO: 623 - protein, 752 aa, Artificial Sequence [sequence omitted]

SEQ ID NO: 624 - protein, 751 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSDYPMQWVRQAPGKGLEWVSWIGPSGGWTVYADSVKGRFTISRDNSKNTLYLQMNSLRAEDTAVYYCARDDGIAGFLWGQGTLVTVSSGGGGSGGGGSGGGGSQDIQMTQSPLSLSASVGDRVTITCQASRDISIYLNWYQQKPGKVPKLLIFGASTLRSGVPSRFSGSGSGTDFTLTITSLQPEDVATYYCQKYNSAPYTFGPGTKVEIR

SEQ ID NO: 625 - protein, 759 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYLMHWVRQAPGKGLEWVSGIWPSGGHTLYADSVKGRFTISRDNSKNTLYLQMNSLRAEDTAVYYCAREPLLWFGELSYNWFDPWGQGTLVTVSSGGGGSGGGGSGGGGSQDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIK

SEQ ID NO: 626 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSYYENMAWVRQAPGKGLEWVSGIYPSGGLTYYADSVKGRFTISRDNSKNTLYLQMNSLRAEDTAVYYCARSRRYYDSSDAFDIWGQGTMVTVSSGGGGSGGGGSGGGGSQDIQMTQSPATLSLSPGERATLSCRASQSINTYLAWYQQKPGHPPRLLIYDASNRATGIPDRFSGSGSGTDFTLTISRLEPEDFVVYYCQQYGRSRYTFGQGTKLEIK

SEQ ID NO: 627 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSTYVMYWVRQAPGKGLEWVSGIGPSGGNTFYADSVKGRFTISRDNSKNTLYLQMNSLRAEDTAVCYCARDPGDFWSGYYGMDVWGQGTTVTVSSGGGGSGGGGSGGGGSQDIQMTQSPSSLSASVGDRVTITCRASQGISNYLAWYQQKPGKVPKLLINAASTLQSGVPSRFSGSGSGTEFTLTISSLQPEDFATYYCQQSDNIPYTFGLGTKLEIK

SEQ ID NO: 628 - protein, 758 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSFYGMAWVRQAPGKGLEWVSSIYPSGGYTDYADSVKGRFTISRDNSKNTLYLQMNSLRAEDTAVYYCARSAGGWIGGGAFDIWGQGTMVTVSSGGGGSGGGGSGGGGSQSELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGIGTKVTVL

SEQ ID NO: 629 - protein, 760 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSKYPMMWVRQAPGKGLEWVSYIYPSGGKTAYADSVKGRFTISRDNSKNTLYLQMNSLRAEDTAVYYCATYGSGSYYLYYYYYYMDVWGKGTTVTVSSGGGGSGGGGSGGGGSQDIQMTQSPSSLSASVGDSVTIACRASQSISTYLNWYQQKPGQAPKLLIYEATNLQSGVPSRFSGSGSGTDFTLTISSLQPEDVATYYCQQANNFPFTFGPGTKVDIK

SEQ ID NO: 630 - protein, 761 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYSMWWVRQAPGKGLEWVSYIVPSGGETIYADSVKGRFTISRDNSKNTLYLQMNSLRAEDTAVYYCAKNLGEGFWSDYYPPLDYWGQGTLVTVSSGGGGSGGGGSGGGGSQSVLTQPPSASGTPGQRVTISCSGSSSNIGGNAVNWYQQLPGTAPKLVLYSSNHRPSGVPDRFSGSRSGTSASLAISGLQSQDEADYYCAAWDDSLNGPLFGGGTKLTVL

SEQ ID NO: 631 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYGMHWVRQAPGKGLEWVSSIYPGMTQYADSVKGRFTISRDNSKNTLYLQMNSLRAEDTAVYYCARDRGSGIDAFDIWGQGTMVTVSSGGGGSGGGGSGGGGSQSELTQPPSVSVSPGQTATVSCSGEKLGDRYAWWYQQKAGQSPVLVIYQDTKRPSGVPDRFSGSNSGTSASLVISGPQSEDEADYYCAAWDDSLKGVVFGGGSKLTVL

SEQ ID NO: 632 - protein, 761 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYDMLWVRQAPGKGLEWVSVISPSGGRTFYADSVKGRFTISRDNSKNTLYLQMNSLRAEDTAVYYCAVTRSMYSSSWYGAPPTHWGQGTLVTVSSGGGGSGGGGSGGGGSQSELTQPPSASGTPGQRVTISCSGRSSNIGSNSVNWYQQLPGTAPKLLIYSNNHRPSGVPDRFSGSKSGTSASLAISGLQSEDEADYYCAAWDDSLYQGVFGGGTKLTVL

SEQ ID NO: 633 - protein, 754 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYKMHWVRQAPGKGLEWVSGISSSGGLTKYADSVKGRFTISRDNSKNTLYLQMNSLRAEDTAVYYCTTERRGDGGAFDIWGQGTMVTVSSGGGGSGGGGSGGGGSQDIQMTQSPSSLSASVGDRVTITCRASQSISSYLNWYQQKPGKAPKLLIYAASSLQSGVPSKFSGSGSGTDFTLTISSLLPEDFATYYCQQYEYFPPTFGQGTKVEIK

SEQ ID NO: 634 - protein, 757 aa, Artificial Sequence [sequence omitted]

SEQ ID NO: 635 - protein, 749 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSSYWMHWVRQAPGKGLEWVSSIYPSGGSTEYADSVKGRFTISRDNSKNTLYLQMNSLRAEDTAVYYCAKGIWFDPWGQGTLVTVSSGGGGSGGGGSGGGGSQDIQMTQSPATLSASVGDRVTITCRSSQRISGYLNWYQQQPGKAPKLLIYAASTLQSGVPSRISGSGSGTDFSLIISSLQPEDVATYYCQQSYSPPFTFGQGTKVEIK

SEQ ID NO: 636 - protein, 755 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGPLRLSCAASGFTFSRYGMMWVRQAPGKGLEWVSYISSSGGFTRYADSVKGRFTISRDNSKNTLYLQMNSLRAEDTAVYYCARVGGYSYGPHFDFWGQGTLVTVSSGGGGSGGGGSGGGGSQDIQMTQSPSTLSASVGDRVTITCRASQSISTWLAWFQQKPGKAPKLLIYKASSLQSGVPSRFSGSGSGTDFTLTISSLQPEDFATYYCQQYKSYPFTFGGGTKVEIK

SEQ ID NO: 637 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYHMIWVRQAPGKGLEWVSWISPSGGFTKYADSVKGRFTISRDNSKNTLYLQMNSLRAEDTAVYYCARYDSRAAAGTNAFDIWGQGTMVTVSSGGGGSGGGGSGGGGSQDIQMTQSPSSLSASVGDSVTITCQASQDIRSYLNWFQQKPGKAPKLLIYDTVNLQTGVPSRFSGSGSGTDYSFTINNLQPEDFATYCCQQYEYLPITFGQGTRLEIK

SEQ ID NO: 638 - protein, 757 aa, Artificial Sequence [sequence omitted]

SEQ ID NO: 639 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSNYWMYWVRQAPGKGLEWVSVISSSGGHTFYADSVKGRFTISRDNSKNTLYLQMNSLRAEDTAVYYCARDYEGGSNDYWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLTISSLQPEDFATYYCQQSYSTPVTFGGGTKVEIK

SEQ ID NO: 640 - protein, 755 aa, Artificial Sequence [sequence omitted]

SEQ ID NO: 641 - protein, 756 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSFYTMWWVRQAPGKGLEWVSSIYPSGGQTLYADSVKGRFTISRDNSKNTLYLQMNSLRAEDTAVYYCARPDSYGYLYYGMDVWGQGTTVTVSSGGGGSGGGGSGGGGSQDIQMTQSPSSLSASVGDRVTITCRASQSIGTYLNWYQQKPGKAPNLLIYGTSSLQRGVPSRFSGSGSGTDFTLTISTLQPEDFVHYYCQQSYTSPPTFGQGTKVEVK

SEQ ID NO: 642 - protein, 747 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYPMEWVRQAPGKGLEWVSGIGPSGGQTTYADSVKGRFTISRDNSKNTLYLQMNSLRAEDTAVYYCARGSYSFIWGQGTMVTVSSGGGGSGGGGSGGGGSQYELTQSPSVSVSPGQTASIPCSGDQLGGKFTSWYQQKAGQSPLLVIYQDTKRPSGIPERFSGSNSGNTATLTITGTQAMDEADYYCLVWDSNTYVFGPGTKVTVL

SEQ ID NO: 643 - protein, 759 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSLYKMAWVRQAPGKGLEWVSVIGSSGGRTPYADSVKGRFTISRDNSKNTLYLQMNSLRAEDTAVYYCARAPLSGWFGQAHDAFDIWGQGTMVTVSSGGGGSGGGGSGGGGSQYELTQSPSVSVAPGQTARITCGGNNIGSKSVHWYQQKPGQAPVLVVYDDSDRPSGIPERFSGSNSGNTATLTVSRVEAGDEADYYCQVWDSSGGLQVFGTGTKVTVL

SEQ ID NO: 644 - protein, 756 aa, Artificial Sequence [sequence omitted]

SEQ ID NO: 645 - protein, 751 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSVYPMHWVRQAPGKGLEWVSSIYSSGGFTMYADSVKGRFTISRDNSKNTLYLQMNSLRAEDTAVYYCVREGVADAFDIWGQGTMVTVSSGGGGSGGGGSGGGGSQDIQMTQSPSTLSASVGDRVTITCRASQSISSWLAWYQQKPGKAPKLLIYKASSLESGVPSRFSGSGSGTEFTLTISSLQPDDFATYHCQQYKSYWTFGQGTKVEIK

SEQ ID NO: 646 - protein, 756 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSSYTMHWVRQAPGKGLEWVSSISPSGGMTFYADSVKGRFTISRDNSKNTLYLQMNSLRAEDTAVYYCARTYDFWSGYFDYWGQGTLVTVSSGGGGSGGGGSGGGGSQSELTQPPSVSEAPRQRVTVSCSGSPSNIGSNSVNWYQQLPGKAPKVVIYYDDLVPSGVSDRFSGSKSGTSASLAISGLQSEDEADYYCAAWDDRLNGWVFGGGTKLTVL

SEQ ID NO: 647 - protein, 759 aa, Artificial Sequence [sequence omitted]

SEQ ID NO: 648 - protein, 754 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSNYNMYWVRQAPGKGLEWVSYISPSGGMTKYADSVKGRFTISRDNSKNTLYLQMNSLRAEDTAVYYCARRGVLGYYGMDVWGQGTMVTVSSGGGGSGGGGSGGGGSQDIQMTQSPSSLSASVGDRVTITCRASQSISSYLNWYQQKPGKAPKLLIYAASSLQSGVPSRFSGSGSGTDFTLTISSLQPEDFATYYCQQSYSTPYTFGQGTKLEIK

SEQ ID NO: 649 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSLYSMNWVRQAPGKGLEWVSSISSSGGATLYADSVKGRFTISRDNSKNTLYLQMNSLRAEDTAVYYCARDLISSGYYPDAFDIWGQGTMVTVSSGGGGSGGGGSGGGGSQDIQMTQSPGTLSLSPGERATLSCRASQSVSSSYLAWYQQKPGQAPRLLIYGASNRVTGIPDRFSGSGSGTDFTLTISRLEPEDSAVYYCHQYGSQYTFGPGTKLEIK

SEQ ID NO: 650 - protein, 762 aa, Artificial Sequence [sequence omitted]

SEQ ID NO: 651 - protein, 755 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSWYSMIWVRQAPGKGLEWVSSIVPSGGLTWYADSVKGRFTISRDNSKNTLYLQMNSLRAEDTAVYYCARDVYGDYYFDNWGQGTLVTVSSGGGGSGGGGSGGGGSQSELTQPPSVSEAPGQRVTISCSGSTSNIGNNAVIWYQQLPGKAPKLLIYYDDLLPSGVSDRFSGSKSGTSGSLAISGLQSEDEADYYCASWDDNLNGPLFGGGTKLTVL

SEQ ID NO: 652 - protein, 753 aa, Artificial Sequence [sequence omitted]

SEQ ID NO: 653 - protein, 754 aa, Artificial Sequence [sequence omitted]

SEQ ID NO: 654 - protein, 759 aa, Artificial Sequence [sequence omitted]

SEQ ID NO: 655 - protein, 753 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSSYFMGWVRQAPGKGLEWVSSIWPSGGNTTYADSVKGRFTISRDNSKNTLYLQMNSLRAEDTAVYYCARHVGWGRYFDYWGQGTLVTVSSGGGGSGGGGSGGGGSQDIQMTQSPSSLSASVGDRVTITCRASQNIYHYLHWYQQKPGKAPKLLIYAASTLESGVPSRFSGSGSGTDLTLTINSLQPEDFATYYCQQTYDTPLTFGGGSKVEVK

SEQ ID NO: 656 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSAYRMIWVRQAPGKGLEWVSYISSSGGRTDYADSVKGRFTISRDNSKNTLYLQMNSLRAEDTAVYYCTTGGLRYFDWLAPSMDYWGQGTLVTVSSGGGGSGGGGSGGGGSQSALTQPPSVSVSPGQTASITCSGDKLGEKFASWYQQRPGQSPILVIYQDSKRPSGIPERFSGSNSGNTATLTISGTQTMDEADYYCQAWGGSTAYVFGSGTKVTVL

SEQ ID NO: 657 - protein, 752 aa, Artificial Sequence [sequence omitted]

SEQ ID NO: 658 - protein, 754 aa, Artificial Sequence [sequence omitted]

SEQ ID NO: 659 - protein, 754 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSSRLSCAASGFTFSLYNMQWVRQAPGKGLEWVSGISLSGGKTFYADSVKGRFTISRDNSKNTLYLQMNSLRAEDTAVYYCARDYGVATLDAFDIWGQGTMVTVSSGGGGSGGGGSGGGGSQSELTQTPSVSVSPGQTASITCSGNRLEDKYVHWYQQKPGQSPVLVLYQDNKRPSGIPERFSGSNSGNTATLTISETQTLDEADYYCQAWDSSTREVFGGGTKLTVL

SEQ ID NO: 660 - protein, 761 aa, Artificial Sequence [sequence omitted]

SEQ ID NO: 661 - protein, 757 aa, Artificial Sequence [sequence omitted]

SEQ ID NO: 662 - protein, 755 aa, Artificial Sequence [sequence omitted]

SEQ ID NO: 663 - protein, 755 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSKYDMWWVRQAPGKGLEWVSSIWPSGGWTSYADSVKGRFTISRDNSKNTLYLQMNSLRAEDTAVYYCAKSRGSPWYGDFDHWGQGTLVTVSSGGGGSGGGGSGGGGSQSELTQPPSVSVAPGETATVTCGGINIGSKSVHWYQQKPDQAPVVVMYFDSDRPSGIPERFSGSNSGDTATLTISRVEAGDEADYYCQVWDSRSDQYVFGFGTKVTVL

SEQ ID NO: 664 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSMYTMHWVRQAPGKGLEWVSWISPSGGWTKYADSVKGRFTISRDNSKNTLYLQMNSLRAEDTAVYYCAVSPWGGPFDYWGQGTLVTVSSGGGGSGGGGSGGGGSQDIQMTQSPSTLSASVGDRVTITCRASQSISSWLAWYQQKPGKAPKLLIYKASTLESGVPSRFSAGGSGTEFTLTISSLQPDDFGTYYCQQYNSYSLTFGGGTKVEII

SEQ ID NO: 665 - protein, 757 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSQYFMMWVRQAPGKGLEWVSSISPSGGYTQYADSVKGRFTISRDNSKNTLYLQMNSLRAEDTAVYYCAKTGDYTRYYSYGMDVWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLIISSLQPEDFATYYCQQSYSTPLTFGGGTKVEIK

SEQ ID NO: 666 - protein, 758 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSGYSMAWVRQAPGKGLEWVSGIYSSGGWTWYADSVKGRFTISRDNSKNTLYLQMNSLRAEDTAVYYCTRDQSFSYDSSLDAFDIWGQGTMVTVSSGGGGSGGGGSGGGGSQDIQMTQSPSSLSASVGDRVTITCRASQSINNYLNWYQQKPGKAPKLLIYTASTLHSGVPSRFSGSGSGTDFTLTISNLQPEDFATYYCQQSYATLRTFGQGTKVEIK

SEQ ID NO: 667 - protein, 760 aa, Artificial Sequence [sequence omitted]

SEQ ID NO: 668 - protein, 752 aa, Artificial Sequence
  Made in a lab
MDFQVQIFSFLLISASVIMSRGLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGDTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSEVQLLESGGGLVQPGGSLRLSCAASGFTFSHYGMDWVRQAPGKGLEWVSSIYSSGGYTLYADSVKGRFTISRDNSKNTLYLQMNSLRAEDTATYYCATRTWADAFDVWGQGTTVTVSSGGGGSGGGGSGGGGSQDIQMTQSPSTLSASVGDRVTFTCRASQSVNNWVAWYQQKPGKAPKLLIYAASSLQSGVPSRFSGSGSGTDFTLTISSLQPEDFATYYCQQSYSMPLTFGGGTKVEIK

SEQ ID NO: 669 - protein, 752 aa, Artificial Sequence
  Made in a lab
MDFQVQIFSFLLISASVIMSRGEVQLLESGGGLVQPGGSLRLSCAASGFTFSHYMMAWVRQAPGKGLEWVSYIYPSGGWTSYADSVKGRFTISRDNSKNTLYLQMNSLRAEDTAVYYCARFDYTIGFDFWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGQRHNNSSLNTRTQKARHSPNSLPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 670 - protein, 759 aa, Artificial Sequence [sequence omitted]

SEQ ID NO: 671 - protein, 503 aa, Artificial Sequence
  Made in a lab
MDFQVQIFSFLLISASVIMSRGEVQLLESGGGLVQPGGSLRLSCAASGFTFSFYQMHWVRQAPGKGLEWVSGIYPSGGYTKYADSVKGRFTISRDNSKNTLYLQMNSLRAEDTAVYYCARDLGYGSSWYYFDYWGQGTLVTVSSGGGGSGGGGSGGGGSQSALTQPASVSGSPGQSITISCSGTDSDVGGYNHVSWYQQHPGKAPKLIIYDVDHRPSGISNRFSGSKSGNTASLTISGLQAEDEADYYCSSYRSGSTYVFGTGTKVTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 672 - protein, 497 aa, Artificial Sequence [sequence omitted]

SEQ ID NO: 673 - protein, 499 aa, Artificial Sequence
  Made in a lab
MDFQVQIFSFLLISASVIMSRGEVQLLESGGGLVQPGGSLRLSCAASGFTFSHYSMGWVRQAPGKGLEWVSSIYPSGGSTLYADSVKGRFTISRDNSKNTLYLQMNSLRAEDTAVYYCARWGVGATFDYWGQGTLVTVSSGGGGSGGGGSGGGGSQDIQMTQSPGTLSLSPGERATLSCRASQSVSSSYLAWYQQKPGQAPRLLIYGASSRATGIPDRFSGSGSGTDFTLTISRLEPEDFAVYYCQQYGSSPLWTFGQGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 674 - protein, 497 aa, Artificial Sequence
  Made in a lab
MDFQVQIFSFLLISASVIMSRGEVQLLESGGGLVQPGGSLRLSCAASGFTFSHYMMAWVRQAPGKGLEWVSYIYPSGGWTSYADSVKGRFTISRDNSKNTLYLQMNSLRAEDTAVYYCARFDYTIGFDFWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLTISSLQPEDFATYYCQQSYSTPRTFGQGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 675 - protein, 500 aa, Artificial Sequence
  Made in a lab
MDFQVQIFSFLLISASVIMSRGEVQLLESGGGLVQPGGSLRLSCAASGFTFSWYNMLWVRQAPGKGLEWVSSISPSGGYTVYADSVKGRFTISRDNSKNTLYLQMNSLRAEDTAVYYCARDRGGSPFRPDAFDIWGQGTMVTVSSGGGGSGGGGSGGGGSQSALTQPPSVSVSPGQTARITCSGDKLGEKYVSWYQQRSGQSPLLVISQDTKRPSGIPERFSGSNSGNTATLTISGAQAADEADYYCQTWDSDTYVFGSGSTVTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 676 - protein, 501 aa, Artificial Sequence
  Made in a lab
MDFQVQIFSFLLISASVIMSRGEVQLLESGGGLVQPGGSLRLSCAASGFTFSGYVMGWVRQAPGKGLEWVSSISPSGGYTLYADSVKGRFTISRDNSKNTLYLQMNSLRAEDTAVYYCARAFSTRWYWGAFDIWGQGTMVTVSSGGGGSGGGGSGGGGSQDIQMTQSPATLSLSPGERATLSCRASQSVRSYLAWYQQKPGQAPRLLIYDASNRATGIPARFSGSGSGTDFTLTITSLQPEDIATYYCQQYDNLPLTFGGGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 677 - protein, 504 aa, Artificial Sequence
  Made in a lab
MDFQVQIFSFLLISASVIMSRGEVQLLESGGGLVQPGGSLRLSCAASGFTFSIYHMNWVRQAPGKGLEWVSGISSSGGRTNYADSVKGRFTISRDNSKNTLYLQMNSLRAEDTAVYYCASSYRAAGWVDYYYGMDVWGQGTTVTVSSGGGGSGGGGSGGGGSQDIQMTQSPSSLSAFVGDRVTITCRTSQSVATYVNWYQQKPGEGPKLLIYAASSLQSGVPSRFRGSGSGTDFTLTIGSLQPEDFATYYCQQSYSVPITFGQGTRLDIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 678 - protein, 496 aa, Artificial Sequence
  Made in a lab
MDFQVQIFSFLLISASVIMSRGEVQLLESGGGLVQPGGSLRLSCAASGFTFSDYPMQWVRQAPGKGLEWVSWIGPSGGWTVYADSVKGRFTISRDNSKNTLYLQMNSLRAEDTAVYYCARDDGIAGFLWGQGTLVTVSSGGGGSGGGGSGGGGSQDIQMTQSPLSLSASVGDRVTITCQASRDISIYLNWYQQKPGKVPKLLIFGASTLRSGVPSRFSGSGSGTDFTLTITSLQPEDVATYYCQKYNSAPYTFGPGTKVEIRTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 679 - protein, 504 aa, Artificial Sequence
  Made in a lab
MDFQVQIFSFLLISASVIMSRGEVQLLESGGGLVQPGGSLRLSCAASGFTFSWYLMHWVRQAPGKGLEWVSGIWPSGGHTLYADSVKGRFTISRDNSKNTLYLQMNSLRAEDTAVYYCAREPLLWFGELSYNWFDPWGQGTLVTVSSGGGGSGGGGSGGGGSQDIQMTQSPSSVSASVGDRVTITCRASQGISSWLAWYQQKPGKAPKLLIYAASSLQSGVPSRFSGSGSGTDFTLTISSLQPEDFATYYCQQANSFPLTFGGGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 680 - protein, 503 aa, Artificial Sequence
  Made in a lab
MDFQVQIFSFLLISASVIMSRGEVQLLESGGGLVQPGGSLRLSCAASGFTFSFYGMAWVRQAPGKGLEWVSSIYPSGGYTDYADSVKGRFTISRDNSKNTLYLQMNSLRAEDTAVYYCARSAGGWIGGGAFDIWGQGTMVTVSSGGGGSGGGGSGGGGSQSELTQPPSASGTPGQRVTISCSGSSSNIGSNTVNWYQQLPGTAPKLLIYSNNQRPSGVPDRFSGSKSGTSASLAISGLQSEDEADYYCAAWDDSLNGYVFGIGTKVTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 681 - protein, 506 aa, Artificial Sequence
  Made in a lab
MDFQVQIFSFLLISASVIMSRGEVQLLESGGGLVQPGGSLRLSCAASGFTFSWYSMWWVRQAPGKGLEWVSYIVPSGGETIYADSVKGRFTISRDNSKNTLYLQMNSLRAEDTAVYYCAKNLGEGFWSDYYPPLDYWGQGTLVTVSSGGGGSGGGGSGGGGSQSVLTQPPSASGTPGQRVTISCSGSSSNIGGNAVNWYQQLPGTAPKLVLYSSNHRPSGVPDRFSGSRSGTSASLAISGLQSQDEADYYCAAWDDSLNGPLFGGGTKLTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 682 - protein, 497 aa, Artificial Sequence
  Made in a lab
MDFQVQIFSFLLISASVIMSRGEVQLLESGGGLVQPGGSLRLSCAASGFTFSHYGMHWVRQAPGKGLEWVSSIYPGMTQYADSVKGRFTISRDNSKNTLYLQMNSLRAEDTAVYYCARDRGSGIDAFDIWGQGTMVTVSSGGGGSGGGGSGGGGSQSELTQPPSVSVSPGQTATVSCSGEKLGDRYAWWYQQKAGQSPVLVIYQDTKRPSGVPDRFSGSNSGTSASLVISGPQSEDEADYYCAAWDDSLKGVVFGGGSKLTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 683 - protein, 506 aa, Artificial Sequence
  Made in a lab
MDFQVQIFSFLLISASVIMSRGEVQLLESGGGLVQPGGSLRLSCAASGFTFSWYDMLWVRQAPGKGLEWVSVISPSGGRTFYADSVKGRFTISRDNSKNTLYLQMNSLRAEDTAVYYCAVTRSMYSSSWYGAPPTHWGQGTLVTVSSGGGGSGGGGSGGGGSQSELTQPPSASGTPGQRVTISCSGRSSNIGSNSVNWYQQLPGTAPKLLIYSNNHRPSGVPDRFSGSKSGTSASLAISGLQSEDEADYYCAAWDDSLYQGVFGGGTKLTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 684 - protein, 494 aa, Artificial Sequence
  Made in a lab
MDFQVQIFSFLLISASVIMSRGEVQLLESGGGLVQPGGSLRLSCAASGFTFSSYWMHWVRQAPGKGLEWVSSIYPSGGSTEYADSVKGRFTISRDNSKNTLYLQMNSLRAEDTAVYYCAKGIWFDPWGQGTLVTVSSGGGGSGGGGSGGGGSQDIQMTQSPATLSASVGDRVTITCRSSQRISGYLNWYQQQPGKAPKLLIYAASTLQSGVPSRISGSGSGTDFSLIISSLQPEDVATYYCQQSYSPPFTFGGGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 685 - protein, 501 aa, Artificial Sequence
  Made in a lab
MDFQVQIFSFLLISASVIMSRGEVQLLESGGGLVQPGGSLRLSCAASGFTFSTYEMNWVRQAPGKGLEWVSGIVPSGGVTYYADSVKGRFTISRDNSKNTLYLQMNSLRAEDTAVYYCARGPYSYGHDYGMDVWGQGTTVTVSSGGGGSGGGGSGGGGSQDIQMTQSPSTLSASVGDRVTITCRASQSISSWLAWYQQKPGKAPKLLIYKASNLESEVPSRFSGSGSGTEFTLTISSLQPDDFATYYCQQYNAYPFIFGGGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 686 - protein, 501 aa, Artificial Sequence
  Made in a lab
MDFQVQIFSFLLISASVIMSRGEVQLLESGGGLVQPGGSLRLSCAASGFTFSSYTMHWVRQAPGKGLEWVSSISPSGGMTFYADSVKGRFTISRDNSKNTLYLQMNSLRAEDTAVYYCARTYDFWSGYFDYWGQGTLVTVSSGGGGSGGGGSGGGGSQSELTQPPSVSEAPRQRVTVSCSGSPSNIGSNSVNWYQQLPGKAPKVVIYYDDLVPSGVSDRFSGSKSGTSASLAISGLQSEDEADYYCAAWDDRLNGWVFGGGTKLTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 687 - protein, 499 aa, Artificial Sequence
  Made in a lab
MDFQVQIFSFLLISASVIMSRGEVQLLESGGGLVQPGGSLRLSCAASGFTFSWYWMTWVRQAPGKGLEWVSSIPPSGGHTSYADSVKGRFTISRDNSKNTLYLQMNSLRAEDTAVYYCAKSSGWYEDYFDYWGQGTLVTVSSGGGGSGGGGSGGGGSQDIQMTQSPSSLSASVGDRVTITCQASQDITNYLNWYLHKPGKAPKLLIYDASNLQTGVPSRFSGSGSGTDFTFTITSLQPEDFGTYYCQQYDTLHPSFGPGTTVDIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 688 - protein, 497 aa, Artificial Sequence
  Made in a lab
MDFQVQIFSFLLISASVIMSRGEVQLLESGGGLVQPGGSLRLSCAASGFTFSAYSMVWVRQAPGKGLEWVSYIYPSGGITTYADSVKGRFTISRDNSKNTLYLQMNSLRAEDTAVYYCAREGQVFDIWGQGTTVTVSSGGGGSGGGGSGGGGSQDIQMTQSPATLSLSPGERATLSCRASQSVTTYLAWYQQRPGQAPRLLIYDASNRATGIPARFSGSGSGTDFTLTISSVEPEDYAVYYCQQRSNWPPSITFGQGTRLESKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 689 - protein, 499 aa, Artificial Sequence
  Made in a lab
MDFQVQIFSFLLISASVIMSRGEVQLLESGGGLVQPGGSLRLSCAASGFTFSNYAMGWVRQAPGKGLEWVSRIVPSGGMTSYADSVKGRFTISRDNSKNTLYLQMNSLRAEDTAVYYCTTDDFWSGMDVWGQGTTVTVSSGGGGSGGGGSGGGGSQSALTQPASVSGSPGQSITISCTGTSSDVGSYNLVSWYQQHPGKAPKVMIYEGSKRPSGVSNRFSGSKSGNTASLTISGLQAEDEADYYCCSYAGRSTYVFGTGTKVTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 690 - protein, 506 aa, Artificial Sequence
  Made in a lab
MDFQVQIFSFLLISASVIMSRGEVQLLESGGGLVQPGGSLRLSCAASGFTFSAYTMHWVRQAPGKGLEWVSSIYPSGGTTPYADSVKGRFTISRDNSKNTLYLQMNSLRAEDTATYYCARVVNIDFWSGYNMRSAFDIWGQGTMVTVSSGGGGSGGGGSGGGGSQDIQMTQSPSSVSASVGDTVTITCRASQGVSDWLAWYQQKPGKAPNLLIYGASSLQTGVPSRFSGGGSGTDFTLTISSLQPEDFATYYCQQAHSFPFTFGGGTRVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 691 - protein, 500 aa, Artificial Sequence
  Made in a lab
MDFQVQIFSFLLISASVIMSRGEVQLLESGGGLVQPGGSLRLSCAASGFTFSEYGMSWVRQAPGKGLEWVSSIRSSGGWTKYADSVKGRFTISRDNSKNTLYLQMNSLRAEDTAVYYCAKGLGATSGEFDYWGQGTLVTVSSGGGGSGGGGSGGGGSQDIQMTQSPGTLSLSPGERATLSCRASQSVSGNYLAWYQQKLGQAPRLLIYGASSRATGTPDRFSGSGSGTEFTLTISSLQPEDFATYYCLQHNSYPLTFGEGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 692 - protein, 502 aa, Artificial Sequence
  Made in a lab
MDFQVQIFSFLLISASVIMSRGEVQLLESGGGLVQPGGSLRLSCAASGFTFSQYFMMWVRQAPGKGLEWVSSISPSGGYTQYADSVKGRFTISRDNSKNTLYLQMNSLRAEDTAVYYCAKTGDYTRYYSYGMDVWGQGTLVTVSSGGGGSGGGGSGGGGSQDIQMTQSPSSLSASVGDRVTITCRASQSISSYLNWYQQKPGKAPKLLIYAASSLQSGVPSRFSGSGSGTDFTLIISSLQPEDFATYYCQQSYSTPLTFGGGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 693 - protein, 503 aa, Artificial Sequence
  Made in a lab
MDFQVQIFSFLLISASVIMSRGEVQLLESGGGLVQPGGSLRLSCAASGFTFSGYSMAWVRQAPGKGLEWVSGIYSSGGWTWYADSVKGRFTISRDNSKNTLYLQMNSLRAEDTAVYYCTRDQSFSYDSSLDAFDIWGQGTMVTVSSGGGGSGGGGSGGGGSQDIQMTQSPSSLSASVGDRVTITCRASQSINNYLNWYQQKPGKAPKLLIYTASTLHSGVPSRFSGSGSGTDFTLTISNLQPEDFATYYCQQSYATLRTFGQGTKVEIKTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 694 - protein, 505 aa, Artificial Sequence
  Made in a lab
MDFQVQIFSFLLISASVIMSRGEVQLLESGGGLVQPGGSLRLSCAASGFTFSLYGMHWVRQAPGKGLEWVSSIVPSGGLTRYADSVKGRFTISRDNSKNTLYLQMNSLRAEDTATYYCARLAYYDFWSGRDAFDIWGQGTMVTVSSGGGGSGGGGSGGGGSQSVLTQPASVSGSPGQSITISCSGSSSDVGHYDYVSWYQQHPGKAPKLMIYDVSNRPSGVSNRFSGSKSGNTASLTISGLQADDEAEYYCSSYTSSGTRVFGTGTKVTVLTGEPKSSDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKAYACAVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 695 - protein, 257 aa, Human
MAPVAVWAALAVGLELWAAAHALPAQVAFTPYAPEPGSTCRLREYYDQTAQMCCSKCSPGQHAKVFCTKTSDTVCDSCEDSTYTQLWNWVPECLSCGSRCSSDQVETQACTREQNRICTCRPGWYCALSKQEGCRLCAPLRKCRPGFGVARPGTETSDVVCKPCAPGTFSNTTSSTDICRPHQICNVVAIPGNASMDAVCTSTSPTRSMAPGAVHLPQPVSTRSQHTQPTPEPSTAPSTSFLLPMGPSPPAEGSTGD

SEQ ID NO: 696 - protein, 211 aa, Human
MGLSTVPDLLLPLVLLELLVGIYPSGVIGLVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTT

SEQ ID NO: 697 - DNA, 2270 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaagtactctatgcattgggttcgccaagctcctggtaaaggtttggagtgggtttcttctatctggccttctggtggctggactacttatgctgactccgttaaaggtcgcttcactatctctagagacaactctaagaatactctctacttgcagatgaacagcttaagggctgaggacacggccgtgtattactgtgcgagaggtggttattactacgcccttgactactggggccagggaaccctggtcaccgtctcaagcggtggcggcggttcggggggtggcggaagtggaggtggagggagtcagagcgaattgactcagccaccctcagtgtccgtgtccccaggacagacagccaccatcacctgctctggagaaaaattgggggatatatatgcttcctggtatcagcagaagccaggccagtccccggtcttggtcatctatcaagataccaagcggccctcagggatccctgtgcgattctctggctccaactctgggaacacagccactctgaccatcagcgggacccaggctatggatgaggctgactattactgtcaggcgtgggacagcagcacggtattcggcggagggaccaagctgaccgtcctatgagcggccgc

SEQ ID NO: 698 - DNA, 2297 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctttttaccagatgcattgggttcgccaagctcctggtaaaggtttggagtgggtttctggtatctatccttctggtggctatactaagtatgctgactccgttaaaggtcgcttcactatctctagagacaactctaagaatactctctacttgcagatgaacagcttaagggctgaggacactgcagtctactattgtgcgagagatctagggtacggcagcagctggtactactttgactactggggccagggaaccctggtcaccgtctcaagcggtggcggcggttcggggggtggcggaagtggaggtggagggagtcagagcgctttgactcagcctgcctccgtgtctgggtctcctggacagtcgatcaccatctcctgcagtggaaccgacagtgacgttggtggttataaccatgtctcctggtaccaacaacacccaggcaaggcccccaaactcataatttatgatgtcgatcatcggccctcagggatctctaaccgtttctctggctccaagtctggcaacacggcctccctgaccatctctgggctccaggctgaggacgaggctgattattactgcagctcatatagaagcggtagcacttatgtcttcggaactgggaccaaggtcaccgtcctatgagcggccgc

SEQ ID NO: 699 - DNA, 2276 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaagtactctatgcattgggttcgccaagctcctggtaaaggtttggagtgggtttctggtatctctccttctggctatactcgttatgctgactccgttaaaggtcgcttcactatctctagagacaactctaagaatactctctacttgcagatgaacagcttaagggctgaggacacggccgtgtattactgtgcgagggaccagctgctagaggcttttgatatctggggccaagggaccacggtcaccgtctcaagcggtggcggcggttcggggggtggcggaagtggaggtggagggagtcaagacatccagatgacccagtctccactctccctgtctgcatctgtgggagacagagtcaccatcacttgccgggcaagtcagagcattagcagctatttaaattggtatcagcaaaaaccaggggaagcccctaagctcctcatctatgctgcatccgctttgcaaagtggggtcccgtcaaggttcagtggcagtggacttgggacagttttcactctcaccatcaccagcctgcaacctgaagattctgcaacttactattgtcaacagagttacagtcccccggtcactttcggcggagggaccaaggtggagatcaaatgagcggccgc

SEQ ID NO: 700 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgagtaccctatgaattgggttcgccaagctcctggtaaaggtttggagtgggtttctggtatctattcttctggtggccttactaagtatgctgactccgttaaaggtcgcttcactatctctagagacaactctaagaatactctctacttgcagatgaacagcttaagggctgaggacacggccgtgtattactgtgcgagagatcactacggtgactacgcatttgactactggggccagggaaccctggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaatgagcggccgc

SEQ ID NO: 701 - DNA, 2306 bp, Artificial Sequence
  Made in a lab
agcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctctttacgagatggtttgggttcgccaagctcctggtaaaggtttggagtgggtttctggtatctggccttctggtggctggactcagtatgctgactccgttaaaggtcgcttcactatctctagagacaactctaagaatactctctacttgcagatgaacagcttaagggctgaggacacggccgtgtattactgtgcgagagatctagcagtggctggttgggattactactactactacggtatggacgtctggggccaagggaccacggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtgtcagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattctgcagtttattactgtcagcaacgtagcaactggcctccgttcactttcggcggagggaccaaggtggagatcaaatgagcggccgcc

SEQ ID NO: 702 - DNA, 2300 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggccttgttcagcctggtggttctttacgtctttcttgcgctgcttccggattcactttctctcagtacaatatgatttgggttcgccaagctcctggtaaaggtttggagtgggtttcttggatctcttcttctggcggtactgagtatgctgactccgttaaaggtcgcttcactatctctagagacaactctaagaatactctctacttgcagatgaacagcttaagggctgaggacacggccgtgtattactgtgcaaaagaccgaggatatggttcggggagttatggggcttatgatgcttttgatatctggggtcaagggacaatggtcaccgtctcaagcggtggcggcggttcggggggtggcggaagtggaggtggagggagtcaagacatccagatgacccagtctccatcctccctgtctgcatctgtaggagacagagtcaccatcacttgccagacaagtcagagcattgacaggtatttaaattggtatcagcagaaagcaggggaagcccctaaactcctgatctatgctgcatccagtttgcaaagtggggtcccatcaaggttcagtggcagtggatctgggacagatttcactctcaccatcagcagtctgcaacctgaagattttgcaagttactactgtcaacagagttacaggaccccccggacgttcggccaagggaccaaggtggagatcaaatgagcggccgc

SEQ ID NO: 703 - DNA, 2285 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattactctatgggttgggttcgccaagctcctggtaaaggtttggagtgggtttcttctatctatccttctggtggctctactctttatgctgactccgttaaaggtcgcttcactatctctagagacaactctaagaatactctctacttgcagatgaacagcttaagggctgaggacacggccgtgtattactgtgcgagatggggagtgggagctacgttcgactactggggccagggcaccctggtcaccgtctcaagcggtggcggcggttcggggggtggcggaagtggaggtggagggagtcaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctctggacgttcggccaagggaccaaggtsgaaatcaaatgagcggccgc

SEQ ID NO: 704 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattacatgatggcttgggttcgccaagctcctggtaaaggtttggagtgggtttcttatatctatccttctggtggctggacttcttatgctgactccgttaaaggtcgcttcactatctctagagacaactctaagaatactctctacttgcagatgaacagcttaagggctgaggacacggccgtgtattactgtgcgagattcgactatactataggttttgacttctggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaatgagcggccgc

SEQ ID NO: 705 - DNA, 2376 bp, Artificial Sequence
  Made in a lab
ggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattacggtatgacttgggttcgccaagctcctggtaaaggtttggagtgggtttctggtatccgttcttctggtggcgttactaattatgctgactccgttaaaggtcgcttcactatctctagagacaactctaagaatactctctacttgcagatgaacagcttaagggctgaggacacggccgtgtattactgtgcgagagagggcagtggctggtccaaggcttttgatatctggggccaagggacaatggtcaccgtctcaagcggtggcggcggttcggggggtggcggaagtggaggtggagggagtcaagacatccagatgacccagtctccagccaccctgtctttgtctccaggagaaagagccaccctctcctgtagggccagccagagtattagcacctccttagcctggtaccaacaaatacctgggcaggctcccaggctcctcatgtatgatgcatccaagagggccagtggcatcccggccaggttcagtggcagtgggtctgggacagacctcactctcaccatcagcagcctcgagcctgaagattctgcggtttattactgtcagctgcgtataaactggcctccggaattcactttcggccctgggaccaaagtggatatcaaatgagcggccgcctcgagtctagagggccctattctatagtgtcacctaaatgctagag

SEQ ID NO: 706 - DNA, 2306 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattacaatatgcgttgggttcgccaagctcctggtaaaggtttggagtgggtttcttctatctctccttctggtggctttactggttatgctgactccgttaaaggtcgcttcactatctctagagacaactctaagaatactctctacttgcagatgaacagcttaagggctgaggacacggccgtgtattactgtgcaagagggatcaattactatgatagtagtggttattaccccccggtcggtatggacgtctggggccaagggaccacggtcaccgtctcaagcggtggcggcggttcggggggtggcggaagtggaggtggagggagtcaagacatccagatgacccagtctccatcttccgtgtctgcatctgtaggagacagagtcaccatcacttgtcgggcgagtcggggtgttatcacctggttaaactggtatcaacagaaaccagggagagtccctagccccctgatctttggtgcatccactttgcaaactggggtcccatcaagattcagcggcagtggatctgggacagatttcactctcaccatcaacgacctgcagcctgaagattttgcaacttactattgtcaacagactcacagtttccctctcactttcggcggagggaccaaggtggagatcaaatgagcggccgc

SEQ ID NO: 707 - DNA, 2288 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtacaatatgctttgggttcgccaagctcctggtaaaggtttggagtgggtttcttctatctctccttctggtggctatactgtttatgctgactccgttaaaggtcgcttcactatctctagagacaactctaagaatactctctacttgcagatgaacagcttaagggctgaggacacggccgtgtattactgtgcacgggaccgtggtgggagccccttccggcctgatgcttttgatatctggggccaagggacaatggtcaccgtctcaagcggtggcggcggttcggggggtggcggaagtggaggtggagggagtcagagcgctttgactcagccaccctcagtgtccgtgtccccaggacagacagccaggatcacctgctctggagataagttgggggaaaaatatgtttcctggtatcagcagcggtcaggccagtcccctctactggtcatttctcaagataccaagcggccctcagggatccctgagcgattctctggctccaactctgggaacacagccactctgaccatcagcggggcccaggctgcagatgaggctgactattactgtcagacgtgggacagcgacacttatgtcttcggaagtgggagcacggtcaccgtcctgtgagcggccgc

SEQ ID NO: 708 - DNA, 2389 bp, Artificial Sequence
  Made in a lab
tggcttatcgattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgagtacgatatgctttgggttcgccaagctcctggtaaaggtttggagtgggtttcttctatctggccttctggtggctttactcagtatgctgactccgttaaaggtcgcttcactatctctagagacaactctaagaatactctctacttgcagatgaacagcttaagggctgaggacacggctgtgtattactgtgcgaggaattattacgatttttggagtggtccttactactacggtatggacgtctggggccaagggaccacggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccctatggacgttcggccaagggaccaaggtggaaatcaaatgagcggccgcctcgagtctagagggccctattctatagtgtcacctaaatgctagagctcg

SEQ ID NO: 709 - DNA, 2290 bp, Artificial Sequence
  Made in a lab
agcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctggttacgttatgggttgggttcgccaagctcctggtaaaggtttggagtgggtttcttctatctctccttctggtggctatactctttatgctgactccgttaaaggtcgcttcactatctctagagacaactctaagaatactctctacttgcagatgaacagcttaagggctgaggacacggctgtgtattactgtgcgagagcatttagcaccaggtggtactggggtgcttttgatatctggggccaagggacaatggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtgttaggagctacttagcctggtaccaacagaaacctggccaggctcccaggctcctcatctatgatgcatccaacagggccactggcatcccagccaggttcagtggcagtgggtctgggacagacttcactctcaccatcaccagcctgcagcctgaagatattgcaacatattactgtcaacagtatgataacctcccgctcactttcggcggagggaccaaggtggagatcaaatgagcggccgc

SEQ ID NO: 710 - DNA, 2300 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctatttaccatatgaattgggttcgccaagctcctggtaaaggtttggagtgggtttctggtatctcttcttctggtggccgtactaattatgctgactccgttaaaggtcgcttcactatctctagagacaactctaagaatactctctacttgcagatgaacagcttaagggctgaggacacggccgtgtattactgtgcgagttcctaccgagcagctggttgggtggactactactacggtatggacgtctggggccaagggaccacggtcaccgtctcaagcggtggcggcggttcggggggtggcggaagtggaggtggagggagtcaagacatccagatgacccagtctccatcctccctgtctgcatttgtaggagacagagtcaccatcacttgccggacaagtcagagcgttgccacctatgtaaattggtatcagcagaaaccaggagaaggccctaagctcctgatctatgctgcatccagtttacaaagtggggtcccatcgaggttcagaggcagtggatctgggacagatttcactctcaccatcggcagtctgcaacctgaagattttgcaacttactactgtcaacagagttacagtgtgccaatcaccttcggccaagggacacgactggacattaaatgagcggccgc

SEQ ID NO: 711 - DNA, 2376 bp, Artificial Sequence
  Made in a lab
tggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctctttacgatatgcattgggttcgccaagctcctggtaaaggtttggagtgggtttctcgtatctattcttctggtggcactactcagtatgctgactccgttaaaggtcgcttcactatctctagagacaactctaagaatactctctacttgcagatgaacagcttaagggctgaggacaccgccatgtattactgtgcaagagatccgggctatgggtcccaccactcctttgactactggggccagggaaccctggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtatgagtaactggttggcctggtatcagcagaaaccagggaaagcccctaagctcctaatctatgatgtcttcactttgaaaagtggggtcccatcaaggttcagcggcagtagatctgggacagaattcactctcaccatcagcagcctgcagcctgatgactttgcaacttattactgccagcagtatagtgattattctgggatcactttcggccctgggaccgaagtggatatcagatgagcggccgcctcgagtctagagggccctattctatagtgtcacctaaatgctaga

SEQ ID NO: 712 - DNA, 2285 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttcttactatatgacttgggttcgacaagctcctggtaaaggtttggagtgggtttctggtatctattcttctggtggccctactcagtatgctgactccgttaaaggtcgcttcactatctctagagacaactctaagaatactctctacttgcagatgaacagcttaagggctgaggacacggccgtatattactgtgcgagagcggggggggatgcttttgatatctggggccaagggacaatggtcaccgtctcaagcggtggcggcggttcggggggtggcggaagtggaggtggagggagtcagagcgtcttgactcagccaccctcagcgtctgggacccccgggcagagggtcaccatctcttgttctggaagcagctccaacatcggaagtaaagttgtatactggtaccagcaggtaccaggaacggcccccaaactcctcatctataggaatgatcagcggccctcaggggtccctgaccggttctctggctccaagtctggcacctcagcctccctggccatcagtgggctccggtccgaggatgaggctgattattactgtgcagcatgggatgacagcctgagtggtcggtgggtgttcggcggagggaccaagctgaccgtcctatgagcggccgc

SEQ ID NO: 713 - DNA, 2361 bp, Artificial Sequence
  Made in a lab
ttttcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttcttacgagatgttttgggttcgccaagctcctggtaaaggtttggagtgggtttcttctatctctccttctggtggctatacttattatgctgactccgttaaaggtcgcttcactatctctagagacaactctaagaatactctctacttgcagatgaacagcttaagggctgaggacacggccgtgtattactgtgcgacaatgactactagtggttttcatctaatctggggccaagggacaatggtcaccgtctcaagcggtggcggcggttcggggggtggcggaagtggaggtggagggagtcaagacatccagatgacccagtctccagccaccctgtctgcatctgtaggagacagagtcaccatcacttgccgggccagtcagagtattagtagctggttggcctggtatcagcagaaaccagggaaagcccctaagctcctgatctataaggcgtctggtttagaaagtggggtcccatcaaggttcagcggcagtggatctgggacagaattcactctcaccatcagcagcctgcagcctgatgattttgcaacttattactgccaacagtataatagttatccattcactttcggccctgggactaaagtggatatcaagtgagcggccgcctcgagtctagagggccctattctatagtgtcacctaaatgctagag

SEQ ID NO: 714 - DNA, 2276 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgattaccctatgcagtgggttcgccaagctcctggtaaaggtttggagtgggtttcttggatcggtccttctggtggctggactgtttatgctgactccgttaaaggtcgcttcactatctctagagacaactctaagaatactctctacttgcagatgaacagcttaagggctgaggacacggccgtgtattactgtgcgagggatgacggaattgctggattcctatggggccagggcaccctggtcaccgtctcaagcggtggcggcggttcggggggtggcggaagtggaggtggagggagtcaagacatccagatgacccagtctccactctccctgtctgcatctgtaggagacagagtcaccatcacttgccaggcgagtcgagacattagtatctatttaaattggtatcagcagaaaccagggaaagttcctaagctcctgatctttggtgcgtccactttgcgatcaggggtcccatctcggttcagtggcagtggatctgggacagatttcactctcaccatcaccagcctgcagcctgaagatgttgcaacttattactgtcaaaagtataacagtgccccgtacacttttggcccggggaccaaggtcgagatcagatgagcggccgc

SEQ ID NO: 715 - DNA, 2300 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtaccttatgcattgggttcgccaagctcctggtaaaggtttggagtgggtttctggtatctggccttctggtggccatactctttatgctgactccgttaaaggtcgcttcactatctctagagacaactctaagaatactctctacttgcagatgaacagcttaagggctgaggacacggccgtgtattactgtgcgagagagccgttactatggttcggggagttatcgtacaactggttcgacccctggggccagggcaccctggtcaccgtctcaagcggtggcggcggttcggggggtggcggaagtggaggtggagggagtcaagacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggagggaccaaggtggagatcaaatgagcggccgc

SEQ ID NO: 716 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttattacgagaatatggcttgggttcgccaagctcctggtaaaggtttggagtgggtttctggtatctatccttctggtggccttacttattatgctgactccgttaaaggtcgcttcactatctctagagacaactctaagaatactctctacttgcagatgaacagcttaagggctgaggacacggccgtgtattactgtgcgagatccaggaggtactatgatagtagtgatgcttttgatatctggggccaagggacaatggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtattaacacctacttagcctggtatcagcagaagcctggccaccctcccaggctcctcatttatgatgcatccaacagggccactggcatcccagacaggttcagtggcagtgggtctgggacagacttcactctcaccatcagcagactggagcctgaagattttgtagtgtattactgtcagcagtatggtaggtcacggtacacttttggccaggggaccaagctggagatcaaatgagcggccgc

SEQ ID NO: 717 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctacttacgttatgtattgggttcgccaagctcctggtaaaggtttggagtgggtttctggtatcggtccttctggtggcaatactttttatgctgactccgttaaaggtcgcttcactatctctagagacaactctaagaatactctctacttgcagatgaacagcttaagggctgaggacacggccgtgtgttactgtgcgagagacccaggggatttttggagtggttactacggtatggacgtctggggccaagggaccacggtcaccgtctcaagcggtggcggcggttcggggggtggcggaagtggaggtggagggagtcaagacatccagatgacccagtctccatcctccctgtctgcatctgtaggagacagagtcaccatcacttgccgggcgagtcagggcattagcaattatttagcctggtatcagcagaaaccagggaaagttcctaagctcctgatcaatgctgcatccactttgcaatcaggggtcccatctcggttcagtggcagtggatctgggacagaattcactctcaccatcagcagtctgcaacctgaagattttgcaacttactactgtcaacagagtgacaatattccgtacacttttggcctggggaccaaactggagatcaaatgagcggccgc

SEQ ID NO: 718 - DNA, 2297 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctttttacggtatggcttgggttcgccaagctcctggtaaaggtttggagtgggtttcttctatctatccttctggtggctatactgattatgctgactccgttaaaggtcgcttcactatctctagagacaactctaagaatactctctacttgcagatgaacagcttaagggctgaggacacggccgtgtattactgtgcgagatccgcgggaggctggatcggggggggtgcttttgatatctggggccaagggacaatggtcaccgtctcaagcggtggcggcggttcggggggtggcggaagtggaggtggagggagtcagagcgaattgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaattgggaccaaggtcaccgtcctatgagcggccgc

SEQ ID NO: 719 - DNA, 2303 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaagtaccctatgatgtgggttcgccaagctcctggtaaaggtttggagtgggtttcttatatctatccttctggtggcaagactgcttatgctgactccgttaaaggtcgcttcactatctctagagacaactctaagaatactctctacttgcagatgaacagcttaagggctgaggacacggccgtgtattactgtgccacctatggttcagggagttattacctttactactactactactacatggacgtctggggcaaagggaccacggtcaccgtctcaagcggtggcggcggttcggggggtggcggaagtggaggtggagggagtcaagacatccagatgacccagtctccatcctccctgtctgcatctgtgggagacagtgtcaccatcgcttgccgggctagtcagagcattagcacctatttaaattggtatcagcagaaaccagggcaagcccctaagctcctgatctatgaagcaaccaatttgcaaagtggggtcccatcaaggttcagcggcagtggatctgggacagatttcactctcaccatcagcagcctgcagcctgaagatgttgcaacttactactgtcagcaggctaacaatttcccattcactttcggccctgggaccaaagtggatatcaaatgagcggccgc

SEQ ID NO: 720 - DNA, 2306 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtactctatgtggtgggttcgccaagctcctggtaaaggtttggagtgggtttcttatatcgttccttctggtggcgagactatttatgctgactccgttaaaggtcgcttcactatctctagagacaactctaagaatactctctacttgcagatgaacagcttaagggctgaggacacggccgtgtattactgtgcgaaaaaccttggtgaaggattttggagtgattattaccctccgcttgactactggggccagggaaccctggtcaccgtctcaagcggtggcggcggttcggggggtggcggaagtggaggtggagggagtcagagcgtcttgactcagccaccctcagcgtctgggacccccgggcagagggtcaccatctcttgttctggaagcagctccaacatcggaggtaatgctgtaaactggtaccagcagctcccgggaacggcccccaaactcgtcctctatagtagtaatcaccggccctcaggggtccctgaccgattctctggctccaggtctggcacctcagcctccctggccatcagtgggctccagtctcaggatgaggctgattactactgtgcagcatgggatgacagcctgaatggtccgctcttcggcggagggaccaagytgaccgtcctatgagcggccgc

SEQ ID NO: 721 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattacggtatgcattgggttcgccaagctcctggtaaaggtttggagtgggtttcttctatctatcctggcatgactcagtatgctgactccgttaaaggtcgcttcactatctctagagacaactctaagaatactctctacttgcagatgaacagcttaagggctgaggacacggccgtgtattactgtgcgagagatcggggttcggggattgatgcttttgatatctggggccaagggacaatggtcaccgtctcaagcggtggcggcggttcggggggtggcggaagtggaggtggagggagtcagagcgaattgactcagccaccctcagtgtccgtgtccccaggacagacggccaccgtcagctgctctggagaaaaattgggggatagatatgcctggtggtatcaacagaaggcaggccagtcccctgtgctggtcatctatcaagataccaagcggccctcaggggtccctgaccgattctctggctccaactctggcacctcagcctccctggtcatcagtggaccccagtctgaggatgaggctgattattactgtgcagcatgggatgacagcctgaagggtgtggtattcggcggagggtccaagctgaccgtcctatgagcggccgc

SEQ ID NO: 722 - DNA, 2306 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcctgcgctgcttccggattcactttctcttggtacgatatgctttgggttcgccaagctcctggtaaaggtttggagtgggtttctgttatctccccttctggtggccgtactttttatgctgactccgttaaaggtcgcttcactatctctagagacaactctaagaatactctctacttgcagatgaacagcttaagggctgaggacacggccgtgtattactgtgcggttactcgatcgatgtatagcagcagctggtacggggcccccccgactcactggggccagggcaccctggtcaccgtctcaagcggtggcggcggttcggggggtggcggaagtggaggtggagggagtcagagcgaattgactcagccaccctcagcgtctgggacccccgggcagagggtcaccatctcttgttctggaaggagctccaacatcggaagtaatagtgtaaactggtaccagcagctcccaggaacggcccccaaactcctcatctatagtaataatcaccggccctcaggggtccctgaccgattctctggctccaagtctggcacctcagcctccctggccatcagtgggctccagtctgaggatgaggctgattattactgtgcagcatgggatgacagcctgtatcaaggagtgttcggcggagggaccaagctgaccgtcctatgagcggccgc

SEQ ID NO: 723 - DNA, 2371 bp, Artificial Sequence
  Made in a lab
tggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtacaagatgcattgggttcgccaagctcctggtaaaggtttggagtgggtttctggtatctcttcttctggtggccttactaagtatgctgactccgttaaaggtcgcttcactatctctagagacaactctaagaatactctctacttgcagatgaacagcttaagggctgaggacacagccgtgtattactgtaccacagagcggcgcggtgacgggggtgcttttgatatctggggccaagggacaatggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaaattcagcggcagtggatctgggacagatttcactctcaccatcagcagcctgctgcctgaagattttgcaacttattactgccaacagtatgagtatttccctccgacgttcggccaagggaccaaggtggaaatcaaatgagcggccgcctcgagtctagagggccctattctatagtgtcacctaaatgctagag

SEQ ID NO: 724 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgagtacactatgtattgggttcgccaagctcctggtaaaggtttggagtgggtttcttatatctctccttctggtggcactactaattatgctggctccgttaaaggtcgcttcactatctctagagacaactctaagaatactctctacttgcagatgaacagcttaagggctgaggacacggccgtgtattactgtgcgaaaggagcttggggtgacatctactactacggtatggacgtctggggccaagggaccacggtcaccgtctcaagcggtggcggcggttcggggggtggcggaagtggaggtggagggagtcaagacatccagatgacccagtctccagactccctgtctttgtctccaggggaaagagccaccctctcctgcagggccagtcagagtgtcagcagcagctactcagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcatcgctcactttcggcggagggaccgaggtggagatcaaatgagcggccgc

SEQ ID NO: 725 - DNA, 2359 bp, Artificial Sequence
  Made in a lab
ggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttcttactggatgcattgggttcgccaagctcctggtaaaggtttggagtgggtttcttctatctatccttctggtggctctactgagtatgctgactccgttaaaggtcgcttcactatctctagagacaactctaagaatactctctacttgcagatgaacagcttaagggctgaggacacggccgtgtattactgtgcgaaaggaatctggttcgacccctggggccagggaaccctggtcaccgtctcaagcggtggcggcggttcggggggtggcggaagtggaggtggagggagtcaagacatccagatgacccagtctccagccaccctgtctgcctctgtaggagacagggtcaccatcacttgccggtcaagtcagaggattagcggctatttaaattggtatcagcagcaaccagggaaagcccctaagctcctgatctatgctgcatccaccttacaaagtggggtcccatcaaggatcagtggcagtggatctgggacagatttcagtctcatcatcagcagtctgcaacctgaagatgttgcaacttattattgtcaacagagttacagtcccccgttcacttttggccaagggaccaaggtggaaatcaaatgagcggccgcctcgagtctagagggccctattctatagtgtcacctaaatgctagagctcg

SEQ ID NO: 726 - DNA, 2288 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggtcctttacgtctttcttgcgctgcttccggattcactttctctcgttacggtatgatgtgggttcgccaagctcctggtaaaggtttggagtgggtttcttatatctcttcttctggtggctttactcgttatgctgactccgttaaaggtcgcttcactatctctagagacaactctaagaatactctctacttgcagatgaacagcttaagggctgaggacacggccgtgtattactgtgcgagagtgggtggatacagttatggcccacactttgacttctggggccagggcaccctggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtattagtacctggttggcctggtttcagcagaaaccagggaaagcccctaagctgctgatctataaggcgtctagtttacaaagtggggtcccatcaaggttcagcggcagtggatctgggacagatttcactctcaccatcagcagcctgcagcctgaagattttgcaacttattactgccaacagtataagagttaccctttcactttcgggggagggaccaaggtggagatcaaatgagcggccgc

SEQ ID NO: 727 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtaccatatgatttgggttcgccaagctcctggtaaaggtttggagtgggtttcttggatctctccttctggtggctttactaagtatgctgactccgttaaaggtcgcttcactatctctagagacaactctaagaatactctctacttgcagatgaacagcttaagggctgaggacacggccgtgtattactgtgcgaggtatgactctcgggcagcagctggtacgaatgcttttgatatctggggccaagggacaatggtcaccgtctcaagcggtggcggcggttcggggggtggcggaagtggaggtggagggagtcaagacatccagatgacccagtctccatcctccctgtctgcatctgttggagacagtgtcaccatcacttgccaggcgagtcaggacattaggtcctatttaaattggtttcagcagaaaccagggaaagcccctaagctcctgatctacgacacagtcaatttgcaaacaggggtcccatcgaggttcagtggaagtggatctgggacagattatagtttcaccatcaacaacctgcagcctgaagactttgcaacatattgctgtcaacagtatgaatatctcccgatcaccttcggccaagggacacgactggagattaaatgagcggccgc

SEQ ID NO: 728 - DNA, 2301 bp, Artificial Sequence
  Made in a lab
gcgagggaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctccttacaagatggtttgggttcgccaagctcctggtaaaggtttggagtgggtttctggtatctctccttctggtggctatacttattatgctgactccgttaaaggtcgcttcactatctctagagacaactctaagaatactctctacttgcagatgaacagcttaagggctgaggacacggccgtgtattactgtgcgagagggggatatggctggagctactactactacggtatggacgtctggggccaagggaccacggtcaccgtctcaagcggtggcggcggttcggggggtggcggaagtggaggtggagggagtcaagacatccagatgacccagtctccatcctccctgtctgcatctgtcggggacagagtcaccatcacttgccgggcaagtcagagcatcagcaactatttaaattggtatcagcagaaatcagggaaagcccctaacctcctgatgtatgccgcatccagtttacacagtggggtctcgtccaggttcagtggtagtggatctgggacagagttcactctcaccatcagcagtctgcaacctgaagattatgcaacttactactgtcaacagagttacagtacctcgggaacgttcggccaagggaccaaggtggaaatcaaatgagcggccgc

SEQ ID NO: 729 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaattactggatgtattgggttcgccaagctcctggtaaaggtttggagtgggtttctgttatctcttcttctggtggccatactttttatgctgactccgttaaaggtcgcttcactatctctagagacaactctaagaatactctctacttgcagatgaacagcttaagggctgaggacactgcagtctactattgtgcgagagattatgaaggtgggagcaatgactactggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccccgtcactttcggcggagggaccaaggtggagatcaaatgagcggccgc

SEQ ID NO: 730 - DNA, 2288 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaattacgctatgtcttgggttcgccaagctcctggtaaaggtttggagtgggtttcttctatctattcttctggtggctatactgcttatgctgactccgttaaaggtcgcttcactatctctagagacaactctaagaatactctctacttgcagatgaacagcttaagggctgaggacaccgccatgtattactgtgcacgggtcccccatgtgtttcggggcgagcttgactactggggccagggaaccctggtcaccgtctcaagcggtggcggcggttcggggggtggcggaagtggaggtggagggagtcaagacatccagatgacccagtctccatcctccctgtctgcatctgtgggagacagagtcgccatcacttgccgcgcaagtcagagcatcgacacctatttaaattggtatcagcataaaccagggaaagcccctaaactcctgatctatgctgcatccagtttgcagagtggggtcccatcaaggttcagtggcagcggatctgggacagatttcactctcaccatcagcggtctgcaacctgaagattttgcaagttatttctgtcaacagagctactctagtccagggatcactttcggcggagggaccagggtggaaatcaaatgagcggccgc

SEQ ID NO: 731 - DNA, 2291 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctttttacactatgtggtgggttcgccaagctcctggtaaaggtttggagtgggtttcttctatctatccttctggtggccagactctttatgctgactccgttaaaggtcgcttcactatctctagagacaactctaagaatactctctacttgcagatgaacagcttaagggctgaggacacggccgtgtattactgtgcgaggcccgacagctatggttacctctactacggtatggacgtctggggccaagggaccacggtcaccgtctcaagcggtggcggcggttcggggggtggcggaagtggaggtggagggagtcaagacatccagatgacccagtctccatcctccctgtctgcatctgtcggagacagagtcaccatcacttgccgggcaagtcagagcattggcacctatttaaactggtatcagcagaagccagggaaagcccctaacctcctgatctatgggacatccagtttgcaaagaggggtcccatcaaggttcagtggcagtggatctgggacagatttcactctcaccataagtaccttgcaacctgaagattttgtacattactactgtcaacagagttacacttcccctccgacgttcggccaagggaccaaggtggaggtcaaatgagcggccgc

SEQ ID NO: 732 - DNA, 2264 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtaccctatggagtgggttcgccaagctcctggtaaaggtttggagtgggtttctggtatcggtccttctggtggccagactacttatgctgactccgttaaaggtcgcttcactatctctagagacaactctaagaatactctctacttgcagatgaacagcttaagggctgaggacacggccgtgtattactgtgcaagagggtcttacagttttatctggggccaagggacaatggtcaccgtctcaagcggtggcggcggttcggggggtggcggaagtggaggtggagggagtcagtacgaattgactcagtcaccctcggtgtccgtgtccccaggacagacagccagcatcccctgctctggagatcaattggggggtaaatttacttcctggtatcaacagaaggcaggccagtctcctctcctggtcatctatcaagatactaagcggccctcagggatccctgagcgattctctggctccaattctgggaacacagccactctgaccatcaccgggacccaggctatggatgaggctgactattactgtctggtgtgggacagcaacacttatgtcttcggacctgggaccaaggtcaccgtcctgtgagcggccgc

SEQ ID NO: 733 - DNA, 2300 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctctttacaagatggcttgggttcgccaagctcctggtaaaggtttggagtgggtttctgttatcggttcttctggtggccgtactccttatgctgactccgttaaaggtcgcttcactatctctagagacaactctaagaatactctctacttgcagatgaacagcttaagggctgaggacacggccgtgtattactgtgcgagagctcctctgagcggatggttcgggcaagcacatgatgcttttgatatctggggccaagggacaatggtcaccgtctcaagcggtggcggcggttcggggggtggcggaagtggaggtggagggagtcagtacgaattgactcagtcaccctcggtgtcagtggccccaggacagacggccaggattacttgtgggggaaacaacattggaagtaaaagtgtacactggtatcagcagaagccaggccaggcccctgtactggtcgtctatgatgatagcgaccggccctcagggatccctgagcgattctctggctccaactctgggaacacggccaccctgaccgtcagcagggtcgaagccggcgatgaggccgactattactgtcaggtgtgggatagtagtggtggtctgcaagtcttcggaactgggaccaaggtcaccgtcctatgagcggccgc

SEQ ID NO: 734 - DNA, 2378 bp, Artificial Sequence
  Made in a lab
tggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctacttacgagatgaattgggttcgccaagctcctggtaaaggtttggagtgggtttctggtatcgttccttctggtggcgttacttattatgctgactccgttaaaggtcgcttcactatctctagagacaactctaagaatactctctacttgcagatgaacagcttaagggctgaggacacggccgtgtattactgtgcgaggggaccgtacagctatggtcacgactacggtatggacgtctggggccaagggaccacggtcaccgtctcaagcggtggcggcggttcggggggtggcggaagtggaggtggagggagtcaagacatccagatgacccagtctccttccaccctgtctgcatctgtaggagacagggtcaccatcacttgccgggccagtcagagtattagtagctggttggcctggtatcagcagaaaccagggaaagcccctaagctcctgatctataaggcgtctaatttagaaagtgaggtcccatcaaggttcagcggcagtggatctgggacagaattcactctcaccatcagcagcctgcagcctgatgattttgcaacttattactgccaacagtataatgcttatccattcattttcggccctgggaccaaagtggatatcaaatgagcggccgcctcgagtctagagggccctattctatagtgtcacctaaatgctagagc

SEQ ID NO: 735 - DNA, 2369 bp, Artificial Sequence
  Made in a lab
ttactggcttatcgaattatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgtttaccctatgcattgggttcgccaagctcctggtaaaggtttggagtgggtttcttctatctattcttctggtggctttactatgtatgctgactccgttaaaggtcgcttcactatctctagagacaactctaagaatactctctacttgcagatgaacagcttaagggctgaggacacggccgtgtattactgtgtgagagaaggggtggcggatgcttttgatatctggggccaagggacaatggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcgtctagtttagaaagtggggtcccatcaaggttcagcggcagtggatctgggacagaattcactctcaccatcagcagcctgcagcctgatgattttgcaacttatcactgccaacagtataaaagttactggacgttcggccaagggaccaaggtggaaatcaaatgagcggccgcctcgagtctagagggccctattctatagtgtcacctaaatgctagagctcg

SEQ ID NO: 736 - DNA, 2291 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttcttacactatgcattgggttcgccaagctcctggtaaaggtttggagtgggtttcttctatctctccttctggtggcatgactttttatgctgactccgttaaaggtcgcttcactatctctagagacaactctaagaatactctctacttgcagatgaacagcttaagggctgaggacactgcagtctactattgtgcgagaacttacgatttttggagtggttattttgactactggggccagggaactctggtcaccgtctcaagcggtggcggcggttcggggggtggcggaagtggaggtggagggagtcagagcgaattgactcagccaccctcggtatctgaagcccccaggcagagggtcaccgtctcctgttctggaagcccctccaacatcggaagtaattctgtaaactggtaccaacagctcccaggaaaggctcccaaagtcgtcatctattatgatgatctggtgccctcaggagtctctgaccgattctctggctccaagtctggcacttcagcctccctggccatcagtgggctccagtctgaggatgaggctgattattactgtgcagcatgggatgacaggctgaatggttgggtgttcggcggagggaccaagctgaccgtcctatgagcggccgc

SEQ ID NO: 737 - DNA, 2299 bp, Artificial Sequence
  Made in a lab
agcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctacttacgagatgggttgggttcgccaagctcctggtaaaggtttggagtgggtttctgttatctggtcttctggtggccatacttggtatgctgactccgttaaaggtcgcttcactatctctagagacaactctaagaatactctctacttgcagatgaacagcttaagggctgaggacacggctgtgtattactgtgcgagaagcaatcagggcgatttttggagtggttatccgtttgcttttgatatctggggccaagggacaatggtcaccgtctcaagcggtggcggcggttcggggggtggcggaagtggaggtggagggagtcaagacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggagggaccaaggtggagatcaaatgagcggccgc

SEQ ID NO: 738 - DNA, 2362 bp, Artificial Sequence
  Made in a lab
tatcgattatacgactcactatagggagacccaagcttgcccccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaattacaatatgtattgggttcgccaagctcctggtaaaggtttggagtgggtttcttatatctctccttctggtggcatgactaagtatgctgactccgttaaaggtcgcttcactatctctagagacaactctaagaatactctctacttgcagatgaacagcttaagggctgaggacacggccgtatattactgtgcgaggaggggagtgctggggtactacggtatggacgtctggggccaagggacaatggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccgtacacttttggccaggggaccaagctggagatcaaatgagcggccgcctcgagtctagagggccctattctatagtgtcacctaaatgctag

SEQ ID NO: 739 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctctttactctatgaattgggttcgccaagctcctggtaaaggtttggagtgggtttcttctatctcttcttctggtggcgctactctttatgctgactccgttaaaggtcgcttcactatctctagagacaactctaagaatactctctacttgcagatgaacagcttaagggctgaggacacggccgtgtattactgtgcgagagatcttataagtagtggttattaccctgatgcttttgatatctggggccaagggacaatggtcaccgtctcaagcggtggcggcggttcggggggtggcggaagtggaggtggagggagtcaagatatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcgtctaatagggtcactggcatccccgacaggttcagtggcagtgggtctgggacagacttcactctcaccatttccagactcgagcctgaagattctgcagtatattactgtcaccaatatggtagccagtacacttttggcccggggaccaagctggagatcaaatgagcggccgc

SEQ ID NO: 740 - DNA, 2308 bp, Artificial Sequence
  Made in a lab
agcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcagtacatgatgcattgggttcgccaagctcctggtaaaggtttggagtgggtttcttctatctcttcttctggtggctggacttcttatgctgactccgttaaaggtagcttcactatctctagagacaactctaagaatactctctacttgcagatgaacagcttaagggctgaggacacggccgtgtattactgtgcgagaccgttagccttgggatacgatttttggagtggttatcaagccgccggctttgactactggggccagggaaccctggtcaccgtctcaagcggtggcggcggttcggggggtggcggaagtggaggtggagggagtcaagacatccagatgacccagtctccatcatctctgtctgcatctgtaggagaccgagtcaccatctcttgccaggcgagtcaacacattagcaactttttaaattggtatcagcagaaaccggggaaagcccctaaactcctgatctacgatacatccaatttgcgatcaggggtcccatcacggttcagtgggagtggctctgggacagattttaccttcaccatcagttccctgcagcctgaagatattgcaacatattactgtcaacagtatgataatttccctctcactttcggcggagggaccaaggtggagatcaaatgagcggccgc

SEQ ID NO: 741 - DNA, 2288 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtactctatgatttgggttcgccaagctcctggtaaaggtttggagtgggtttcttctatcgttccttctggtggccttacttggtatgctgactccgttaaaggtcgcttcactatctctagagacaactctaagaatactctctacttgcagatgaacagcttaagggctgaggacacggccgtgtattactgtgcgagagatgtctacggtgactactactttgacaactggggccagggcaccctggtcaccgtctcaagcggtggcggcggttcggggggtggcggaagtggaggtggagggagtcagagcgaattgactcagccaccctcggtgtctgaagcccccgggcagagggtcaccatctcctgttctggaagcacctccaacatcggaaataatgctgtaatctggtaccagcagctcccaggaaaggctcccaaactcctcatctattatgatgatctgctgccctcaggggtctctgaccgattctctggctccaagtctggcacctcaggctccctggccatcagtgggctccagtctgaggatgaggctgactattactgtgcatcatgggatgacaacctgaatggtccgctgttcggcggagggaccaagctgaccgtcctatgagcggccgc

SEQ ID NO: 742 - DNA, 2282 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttattacaatatgacttgggttcgccaagctcctggtaaaggtttggagtgggtttcttctatctctccttctggtggccgtactggttatgctgactccgttaaaggtcgcttcactatctctagagacaactctaagaatactctctacttgcagatgaacagcttaagggctgaggacacggccgtgtattactgtgcgagagtaagtggcttctacgcagcgtttgattactggggccagggaaccctggtcaccgtctcaagcggtggcggcggttcggggggtggcggaagtggaggtggagggagtcaagacatccagatgacccagtctccttccaccctgtctgcatctgtaggagacagagtcaccatcacctgccgggccagtcagagtattagtagttggttggcctggtatcagcagaaaccagggaaagcccctaagctcctgatctatcaggcgtctactttagaaagtggggtcccatcaaggttcagcggcagtggatctgggacagatttcactctcactatcagcagcctacaacctgaagactttgcaacttattattgtcaacaggctaacagttttccgatcactttcggcggagggaccaaagtggagatcaactgagcggccgc

SEQ ID NO: 743 - DNA, 2285 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttggtactggatgacttgggttcgccaagctcctggtaaaggtttggagtgggtttcttctatccctccttctggtggccatacttcttatgctgactccgttaaaggtcgcttcactatctctagagacaactctaagaatactctctacttgcagatgaacagcttaagggctgaggacacggccgtgtattactgtgctaaaagcagtggctggtacgaggactactttgactactggggccagggaaccctggtcaccgtctcaagcggtggcggcggttcggggggtggcggaagtggaggtggagggagtcaagacatccagatgacccagtctccatcctccctgtctgcctctgtaggagacagagtcaccatcacttgccaggcgagtcaagatattaccaactatttaaattggtatctgcataaaccagggaaagcccctaagctcctgatctacgacgcatccaacttgcaaacaggggtcccatcaaggttcagtggaagtggatctgggacagattttactttcaccatcactagcctgcagcctgaagattttggaacatattactgtcaacagtatgatactttacatccctctttcggccctgggaccacagtggatatcaaatgagcggccgc

SEQ ID NO: 744 - DNA, 2300 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctccttacgagatggcttgggttcgccaagctcctggtaaaggtttggagtgggtttctgttatcggtccttctggtggctatactgagtatgctgactccgttaaaggtcgcttcactatctctagagacaactctaagaatactctctacttgcagatgaacagcttaagggctgaggacacggccgtgtattactgtgcgagaggctacgatttttggagtggttattatgatgcttttgatatctggggccaagggacaatggtcaccgtctcaagcggtggcggcggttcggggggtggcggaagtggaggtggagggagtcagagcgctttgactcagccaccctccgcgtccgggtctcctggacaatcagtcaccatctcctgcactggaaccagcagtgacgttggtgtttatgactctgtctcctggtaccaacaacaccctggcaaggcccccaaactcatgatttacgatgtcagtgatcggccctcaggtgtttctaatcggttctctggctccaagtctggctacacggcctccctgaccatctctgcgctccaggctgaggacgaggctgattattattgcggctcatatcgagccagcagctcctatgtcttcgggactgggaccaaggtcaccgtcctatgagcggccgc

SEQ ID NO: 745 - DNA, 2282 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctcttcttactttatgggttgggttcgccaagctcctggtaaaggtttggagtgggtttcttctatctggccttctggtggcaatactacttatgctgactccgttaaaggtcgcttcactatctctagagacaactctaagaatactctctacttgcagatgaacagcttaagggctgaggacacggccgtgtattactgtgcgagacatgttggctggggacgctactttgactactggggccagggaaccctggtcaccgtctcaagcggtggcggcggttcggggggtggcggaagtggaggtggagggagtcaagacatccagatgacccagtctccatcctccctgtctgcatctgttggagacagagtcaccatcacttgccgggcaagtcagaacatttaccactatttacattggtatcagcagaaacccgggaaggcccctaaactcctgatctatgctgcatccactttggaaagtggggtcccatcaaggttcagtggcagtggatctgggacagatctcactctcaccatcaacagtctgcaacctgaagattttgcaacttattactgtcaacagacttacgatacccccctcactttcggcggagggagtaaggtggaggtcaaatgagcggccgc

SEQ ID NO: 746 - DNA, 2294 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgcttaccgtatgatttgggttcgccaagctcctggtaaaggtttggagtgggtttcttatatctcttcttctggtggccgtactgattatgctgactccgttaaaggtcgcttcactatctctagagacaactctaagaatactctctacttgcagatgaacagcttaagggctgaggacacagccgtgtattactgtaccacaggagggttacgatattttgactggttagccccctccatggactactggggccagggaaccctggtcaccgtctcaagcggtggcggcggttcggggggtggcggaagtggaggtggagggagtcagagcgctttgactcagccaccctcagtgtccgtgtccccaggacagacagccagcatcacctgttctggagataaattgggggaaaaatttgcttcttggtatcagcagaggccaggccagtcccctatactggtcatctatcaagattccaagcggccctccgggatccctgagcgattctctggctccaactctgggaacacagccactctgaccatcagcgggacccagactatggatgaggctgactattactgtcaggcgtggggcggcagcactgcatacgtcttcggcagtgggaccaaggtcaccgtcctatgagcggccgc

SEQ ID NO: 747 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgcttactctatggtttgggttcgccaagctcctggtaaaggtttggagtgggtttcttatatctatccttctggtggcattactacttatgctgactccgttaaaggtcgcttcactatctctagagacaactctaagaatactctctacttgcagatgaacagcttaagggctgaggacacggctgtgtattactgtgcgagagagggccaggtttttgatatctggggccaagggaccacggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtgttaccacctacttagcctggtaccaacagagacctggccaggctcccaggctcctcatctatgatgcatccaacagggccactggcatcccagccaggttcagtggcagtgggtctgggacagacttcactctcaccatcagcagcgtagagcctgaagattatgcagtttattactgtcagcagcgtagcaactggcctccttcgatcaccttcggccaagggacacgactggagagtaagtgagcggccgc

SEQ ID NO: 748 - DNA, 2285 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaattacgctatgggttgggttcgccaagctcctggtaaaggtttggagtgggtttctcgtatcgttccttctggtggcatgacttcttatgctgactccgttaaaggtcgcttcactatctctagagacaactctaagaatactctctacttgcagatgaacagcttaagggctgaggacacagccgtgtattactgtaccacagatgatttttggtccggtatggacgtctggggccaagggaccacggtcaccgtctcaagcggtggcggcggttcggggggtggcggaagtggaggtggagggagtcagagcgctttgactcagcctgcctccgtgtctgggtctcctggacagtcgatcaccatctcctgcactggaaccagcagtgatgttgggagttataaccttgtctcctggtaccaacagcacccaggcaaagcccccaaagtcatgatttatgagggcagtaagcggccctcaggggtttctaatcgcttctctggctccaagtctggcaacacggcctccctgacaatctctgggctccaggctgaggacgaggctgattattactgctgctcatatgcaggtcgtagcacttatgtcttcggaactgggaccaaggtcaccgtcctatgagcggccgc

SEQ ID NO: 749 - DNA, 2285 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttcttcacgtctttcttgcgctgcttccggattcactttctctctttacaatatgcagtgggttcgccaagctcctggtaaaggtttggagtgggtttctggtatctctctttctggtggcaagactttttatgctgactccgttaaaggtcgcttcactatctctagagacaactctaagaatactctctacttgcagatgaacagcttaagggctgaggacacggccgtgtattactgtgcgagagattacggggtggctacgctagatgcttttgatatctggggccaagggacaatggtcaccgtctcaagcggtggcggcggttcggggggtggcggaagtggaggtggagggagtcagagcgaattgactcagacaccctctgtgtccgtgtccccaggacagacagccagcatcacctgctctggaaatagattggaggataagtatgttcactggtatcagcagaagccaggccagtcccctgtgttggtcctctatcaagacaacaagcggccctccgggatccctgagcgattctctggctccaactctgggaacacagccactctgaccatcagcgagacccagactttggatgaggctgactattactgtcaggcgtgggacagcagcactcgtgaggttttcggcggagggaccaagctgaccgtcctatgagcggccgc

SEQ ID NO: 750 - DNA, 2306 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgcttacactatgcattgggttcgccaagctcctggtaaaggtttggagtgggtttcttctatctatccttctggtggcactactccttatgctgactccgttaaaggtcgcttcactatctctagagacaactctaagaatactctctacttgcagatgaacagcttaagggctgaggacacagccacatattactgtgccagagtggtgaatatcgatttttggagtggttacaatatgcggagtgcttttgatatctggggccaagggacaatggtcaccgtctcaagcggtggcggcggttcagggggtggcggaagtggaggtggagggagtcaagacatccagatgacccagtctccatcctccgtgtctgcgtctgtaggagacacagtcaccatcacttgtcgggcgagtcagggtgttagcgactggttagcctggtatcagcagaagccagggaaagcccctaacctcctaatctatggtgcatccagtctgcaaactggggtcccatcacggttcagcggcggtggatccgggacagatttcactctcaccatcagtagcctgcagcctgaggattttgcaacttactattgtcaacaggctcacagtttccctttcactttcggcggagggaccagggtggaaatcaaatgagcggccgc

SEQ ID NO: 751 - DNA, 2383 bp, Artificial Sequence
  Made in a lab
tactggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgattaccttatgggttgggttcgccaagctcctggtaaaggtttggagtgggtttctgttatctcttcttctggtggccctactgcttatgctgactccgttaaaggtcgcttcactatctctagagacaactctaagaatactctctacttgcagatgaacagcttaagggctgaggacacggccgtgtattactgtgcgagagtggggcttgactacgggatactgggtgcttttgatatctggggccaagggacaatggtcaccgtctcaagcggtggcggcggttcggggggtggcggaagtggaggtggagggagtcaagacatccagatgacccagtctccagccaccctgtctgtgtctccaggggaaagagccaccctctcctgcagggccagtcagaatattaacacccacttagcctggtaccagcagaaacctggccaggctcccaggctcctcatctttggtgcatccaccagggccactggtatcccagccaggttcagtggcagtgggtctgggacagagttcactctcaccatcagcagcctgcagtctgaagattttacagtttattactgtcagcagtatggtagctcacttacgtggacgttcggccaagggaccaaggtggaaatcaaatgagcggccgcctcgagtctagagggccctattctatagtgtcacctaaatgctagag

SEQ ID NO: 752 - DNA, 2412 bp, Artificial Sequence
  Made in a lab
agaaaaaaactggcttatggcttatcgaaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctgagtacggtatgtcttgggttcgccaagctcctggtaaaggtttggagtgggtttcttctatccgttcttctggtggctggactaagtatgctgactccgttaaaggtcgcttcactatctctagagacaactctaagaatactctctacttgcagatgaacagcttaagggctgaggacacggccgtgtattactgtgcgaaaggcctaggggccactagtggggaatttgactattggggccagggaaccctggtcaccgtctcaagcggtggcggcggttcggggggtggcggaagtggaggtggagggagtcaagacatccagatgacccagtctccaggcaccctgtctttgtctccaggggaaagagccaccctctcctgcagggccagtcagagtgttagcggcaactacttagcctggtaccagcagaaacttggccaggctcccaggctcctcatctatggtgcatccagcagggccactggcaccccagacaggttcagtggcagtgggtctgggacagaattcactctcacaatcagcagcctgcagcctgaagattttgcaacttattactgtctacagcataatagttatccgctcactttcggcggagggaccaaggtggagatcaaatgagcggccgcctcgagtctagagggccctattctatagtgtcacctaaatgctagagcttcgcgattctgtccctaa

SEQ ID NO: 753 - DNA, 2288 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctaagtacgatatgtggtgggttcgccaagctcctggtaaaggtttggagtgggtttcttctatctggccttctggtggctggacttcttatgctgactccgttaaaggtcgcttcactatctctagagacaactctaagaatactctctacttgcagatgaacagcttaagggctgaggacacggccgtgtattactgtgcgaaatcccgtggcagcccctggtacggagattttgaccactggggccagggaaccctggtcaccgtctcaagcggtggcggcggttcggggggtggcggaagtggaggtggagggagtcagagcgaattgactcagccaccctcagtgtcagtggccccaggagagacggccacggtcacctgtgggggaatcaacattggaagtaaaagtgtccactggtatcagcagaagccagaccaggcccctgtggtggtcatgtattttgatagcgaccggccctcagggatccctgagcgattctctggctccaactctggagacacggccaccctgaccatcagcagggtcgaagccggggatgaggccgactattactgtcaggtgtgggatagtcgttctgatcaatatgtcttcggatttgggaccaaggtcaccgtcctatgagcggccgc

SEQ ID NO: 754 - DNA, 2279 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctatgtacactatgcattgggttcgccaagctcctggtaaaggtttggagtgggtttcttggatctctccttctggtggctggactaagtatgctgactccgttaaaggtcgcttcactatctctagagacaactctaagaatactctctacttgcagatgaacagcttaagggctgaggacacggccgtgtattactgtgcggttagtccctggggtggaccctttgactactggggccagggaaccctggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtattagcagctggttggcctggtatcagcagaaacctgggaaagcccctaagctcctgatctataaggcgtctactttagaaagtggggtcccatcacggttcagcgccggtggatctgggacagaattcactctcaccatcagcagcctgcagcctgatgattttggaacttattactgccaacagtataatagttattcgctcactttcggcggagggaccaaggtggagatcatatgagcggccgc

SEQ ID NO: 755 - DNA, 2409 bp, Artificial Sequence
  Made in a lab
tggacaactgcttactggcttatcgaattaatacgactcactatagggagacccaagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcagtactttatgatgtgggttcgccaagctcctggtaaaggtttggagtgggtttcttctatctctccttctggtggctatactcagtatgctgactccgttaaaggtcgcttcactatctctagagacaactctaagaatactctctacttgcagatgaacagcttaagggctgaggacacggccgtgtattactgtgcgaaaaccggtgactacacacgctactactcctacggtatggacgtctggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcatcatcagcagtctgcaacctgaagattttgcaacttactactgtcaacagagttacagtaccccgctcactttcggcggagggaccaaggtggagatcaaatgagcggccgcctcgagtctagagggccctattctatagtgtcacctaaatgctagagctcgctgaccggcc

SEQ ID NO: 756 - DNA, 2297 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctggttactctatggcttgggttcgccaagctcctggtaaaggtttggagtgggtttctggtatctactcttctggtggctggacttggtatgctgactccgttaaaggtcgcttcactatctctagagacaactctaagaatactctctacttgcagatgaacagcttaagggctgaggacacagccgtgtattactgtacaagagaccaatctttctcctatgatagtagtcttgatgcttttgatatctggggccaagggacaatggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagtattaacaactatttaaattggtatcagcagaaaccagggaaagcccctaagctcctgatctatactgcatccactttgcacagtggggtcccatcaaggttcagtggcagtggatctgggacagatttcactctcaccatcagcaatctgcaacctgaagattttgcaacttactactgtcaacagagttacgctaccctccggacgttcggccaagggaccaaggtggagatcaaatgagcggccgc

SEQ ID NO: 757 - DNA, 2303 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctctttacggtatgcattgggttcgccaagctcctggtaaaggtttggagtgggtttcttctatcgttccttctggtggccttactcgttatgctgactccgttaaaggtcgcttcactatctctagagacaactctaagaatactctctacttgcagatgaacagcttaagggctgaggacacagccacatattactgtgcgagactcgcgtattacgatttttggagtggtcgtgatgcttttgatatctggggccaagggacaatggtcaccgtctcaagcggtggcggcggttcggggggtggcggaagtggaggtggagggagtcagagcgtcttgactcagcctgcctccgtgtctgggtctcctggacagtcgatcaccatctcctgcagtggaagcagcagtgacgttggtcattatgactatgtctcctggtaccaacagcacccaggcaaggcccccaaactcatgatttatgatgtcagtaatcggccctcaggggtttctaatcgcttctctggctccaagtctggcaacacggcctccctgaccatctctgggctccaggctgacgacgaggctgagtattactgcagctcatatacaagcagcggcactcgagtcttcggaactgggaccaaggtcaccgtcctatgagcggccgc

SEQ ID NO: 758 - DNA, 2326 bp, Artificial Sequence
  Made in a lab
aagcttgccgccatggattttcaagtgcagattttcagcttcctgctaatcagtgcttcagtcataatgtcgcgaggattgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgacaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctgaagttcaattgttagagtctggtggcggtcttgttcagcctggtggttctttacgtctttcttgcgctgcttccggattcactttctctcattacggtatggattgggttcgccaagctcctggtaaaggtttggagtgggtttcttctatctattcttctggtggctatactctttatgctgactccgttaaaggtcgcttcactatctctagagacaactctaagaatactctctacttgcagatgaacagcttaagggctgaggacacagccacatattactgtgccactagaacgtgggcggatgcttttgatgtctggggccaagggaccacggtcaccgtctcaagcggtggcggcggttcggggggtggcggaagtggaggtggagggagtcaagacatccagatgacccagtctccctccaccttgtctgcatctgtgggagacagagtcactttcacttgccgggccagtcagagtgtcaacaactgggtggcctggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtatgccgctcactttcggcggagggaccaaggtggagatcaaatgagcggccgcctcgagtctagagggccctattctatagtgtcacctaaatgctagag

SEQ ID NO: 759 - DNA, 2280 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctcattacatgatggcttgggttcgccaagctcctggtaaaggtttggagtgggtttcttatatctatccttctggtggctggacttcttatgctgactccgttaaaggtcgcttcactatctctagagacaactctaagaatactctctacttgcagatgaacagcttaagggctgaggacacggccgtgtattactgtgcgagattcgactatactataggttttgacttctggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgactgagcggccgcc

SEQ ID NO: 760 - DNA, 2300 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcctgcgctgcttccggattcactttctcttggtaccttatgcattgggttcgccaagctcctggtaaaggtttggagtgggtttctggtatctggccttctggtggccatactctttatgctgactccgttaaaggtcgcttcactatctctagagacaactctaagaatactctctacttgcagatgaacagcttaagggctgaggacacggccgtgtattactgtgcgagagagccgttactatggttcggggagttatcgtacaactggttcgacccctggggccagggcaccctggtcaccgtctcaagcggtggcggcggttcggggggtggcggaagtggaggtggagggagtcaagacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagcaggtggcagcaggggaacgtcttctcatgctccgtgatgcatgaggctctgcacaaccactacacgcagaagagcctctccctgtctccgggtcagaggcacaacaattcttccctgaatacaagaactcagaaagcacgtcattctccgaattctttgcccgcccaggtggcatttacaccctacgccccggagcccgggagcacatgccggctcagagaatactatgaccagacagctcagatgtgctgcagcaaatgctcgccgggccaacatgcaaaagtcttctgtaccaagacctcggacaccgtgtgtgactcctgtgaggacagcacatacacccagctctggaactgggttcccgagtgcttgagctgtggctcccgctgtagctctgaccaggtggaaactcaagcctgcactcgggaacagaaccgcatctgcacctgcaggcccggctggtactgcgcgctgagcaagcaggaggggtgccggctgtgcgcgccgctgcgcaagtgccgcccgggcttcggcgtggccagaccaggaactgaaacatcagacgtggtgtgcaagccctgtgccccggggacgttctccaacacgacttcatccacggatatttgcaggccccaccagatctgtaacgtggtggccatccctgggaatgcaagcatggatgcagtctgcacgtccacgtcccccacccggagtatggccccaggggcagtacacttaccccagccagtgtccacacgatcccaacacacgcagccaactccagaacccagcactgctccaagcacctccttcctgctcccaatgggccccagccccccagctgaagggagcactggcgactgagcggccgc

SEQ ID NO: 761 - DNA, 1532 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctttttaccagatgcattgggttcgccaagctcctggtaaaggtttggagtgggtttctggtatctatccttctggtggctatactaagtatgctgactccgttaaaggtcgcttcactatctctagagacaactctaagaatactctctacttgcagatgaacagcttaagggctgaggacactgcagtctactattgtgcgagagatctagggtacggcagcagctggtactactttgactactggggccagggaaccctggtcaccgtctcaagcggtggcggcggttcggggggtggcggaagtggaggtggagggagtcagagcgctttgactcagcctgcctccgtgtctgggtctcctggacagtcgatcaccatctcctgcagtggaaccgacagtgacgttggtggttataaccatgtctcctggtaccaacaacacccaggcaaggcccccaaactcataatttatgatgtcgatcatcggccctcagggatctctaaccgtttctctggctccaagtctggcaacacggcctccctgaccatctctgggctccaggctgaggacgaggctgattattactgcagctcatatagaagcggtagcacttatgtcttcggaactgggaccaaggtcaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 762 - DNA, 1514 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctgagtaccctatgaattgggttcgccaagctcctggtaaaggtttggagtgggtttctggtatctattcttctggtggccttactaagtatgctgactccgttaaaggtcgcttcactatctctagagacaactctaagaatactctctacttgcagatgaacagcttaagggctgaggacacggccgtgtattactgtgcgagagatcactacggtgactacgcatttgactactggggccagggaaccctggtcaccgtctcaagcggtggcggcggttcggggggtggcggaagtggaggtggagggagtcaagacatccagatgacccagtctccttccaccctgtctgcatctgtaggagacagagtcaccatcacttgccgggccagtcagagtattagtagctggttggcctggtatcagcagaaaccagggaaagcccctaagctcctgatctataaggcatctagtttagaaagtggggtcccatcaaggttcagcggcagtggatctgggacagaattcactctcaccatcagcagcctgcagcctgatgattttgcaacttattactgccaacagtataatagttattggacgttcggccaagggaccaaggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 763 - DNA, 1520 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctcattactctatgggttgggttcgccaagctcctggtaaaggtttggagtgggtttcttctatctatccttctggtggctctactctttatgctgactccgttaaaggtcgcttcactatctctagagacaactctaagaatactctctacttgcagatgaacagcttaagggctgaggacacggccgtgtattactgtgcgagatggggagtgggagctacgttcgactactggggccagggcaccctggtcaccgtctcaagcggtggcggcggttcggggggtggcggaagtggaggtggagggagtcaagacatccagatgacccagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcagtatggtagctcacctctctggacgttcggccaagggaccaaggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 764 - DNA, 1514 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctcattacatgatggcttgggttcgccaagctcctggtaaaggtttggagtgggtttcttatatctatccttctggtggctggacttcttatgctgactccgttaaaggtcgcttcactatctctagagacaactctaagaatactctctacttgcagatgaacagcttaagggctgaggacacggccgtgtattactgtgcgagattcgactatactataggttttgacttctggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtacccctcggacgttcggccaagggaccaaggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 765 - DNA, 1515 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttggtacaatatgctttgggttcgccaagctcctggtaaaggtttggagtgggtttcttctatctctccttctggtggctatactgtttatgctgactccgttaaaggtcgcttcactatctctagagacaactctaagaatactctctacttgcagatgaacagcttaagggctgaggacacggccgtgtattactgtgcacgggaccgtggtgggagccccttccggcctgatgcttttgatatctggggccaagggacaatggtcaccgtctcaagcggtggcggcggttcggggggtggcggaagtggaggtggagggagtcagagcgctttgactcagccaccctcagtgtccgtgtccccaggacagacagccaggatcacctgctctggagataagttgggggaaaaatatgtttcctggtatcagcagcggtcaggccagtcccctctactggtcatttctcaagataccaagcggccctcagggatccctgagcgattctctggctccaactctgggaacacagccactctgaccatcagcggggcccaggctgcagatgaggctgactattactgtcagacgtgggacagcgacacttatgtcttcggaagtgggagcacggtcaccgtcctgaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatga

SEQ ID NO: 766 - DNA, 1526 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctggttacgttatgggttgggttcgccaagctcctggtaaaggtttggagtgggtttcttctatctctccttctggtggctatactctttatgctgactccgttaaaggtcgcttcactatctctagagacaactctaagaatactctctacttgcagatgaacagcttaagggctgaggacacggctgtgtattactgtgcgagagcatttagcaccaggtggtactggggtgcttttgatatctggggccaagggacaatggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtgttaggagctacttagcctggtaccaacagaaacctggccaggctcccaggctcctcatctatgatgcatccaacagggccactggcatcccagccaggttcagtggcagtgggtctgggacagacttcactctcaccatcaccagcctgcagcctgaagatattgcaacatattactgtcaacagtatgataacctcccgctcactttcggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 767 - DNA, 1527 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctatttaccatatgaattgggttcgccaagctcctggtaaaggtttggagtgggtttctggtatctcttcttctggtggccgtactaattatgctgactccgttaaaggtcgcttcactatctctagagacaactctaagaatactctctacttgcagatgaacagcttaagggctgaggacacggccgtgtattactgtgcgagttcctaccgagcagctggttgggtggactactactacggtatggacgtctggggccaagggaccacggtcaccgtctcaagcggtggcggcggttcggggggtggcggaagtggaggtggagggagtcaagacatccagatgacccagtctccatcctccctgtctgcatttgtaggagacagagtcaccatcacttgccggacaagtcagagcgttgccacctatgtaaattggtatcagcagaaaccaggagaaggccctaagctcctgatctatgctgcatccagtttacaaagtggggtcccatcgaggttcagaggcagtggatctgggacagatttcactctcaccatcggcagtctgcaacctgaagattttgcaacttactactgtcaacagagttacagtgtgccaatcaccttcggccaagggacacgactggacattaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatga

SEQ ID NO: 768 - DNA, 1511 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctgattaccctatgcagtgggttcgccaagctcctggtaaaggtttggagtgggtttcttggatcggtccttctggtggctggactgtttatgctgactccgttaaaggtcgcttcactatctctagagacaactctaagaatactctctacttgcagatgaacagcttaagggctgaggacacggccgtgtattactgtgcgagggatgacggaattgctggattcctatggggccagggcaccctggtcaccgtctcaagcggtggcggcggttcggggggtggcggaagtggaggtggagggagtcaagacatccagatgacccagtctccactctccctgtctgcatctgtaggagacagagtcaccatcacttgccaggcgagtcgagacattagtatctatttaaattggtatcagcagaaaccagggaaagttcctaagctcctgatctttggtgcgtccactttgcgatcaggggtcccatctcggttcagtggcagtggatctgggacagatttcactctcaccatcaccagcctgcagcctgaagatgttgcaacttattactgtcaaaagtataacagtgccccgtacacttttggcccggggaccaaggtggagatcagaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 769 - DNA, 1535 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttggtaccttatgcattgggttcgccaagctcctggtaaaggtttggagtgggtttctggtatctggccttctggtggccatactctttatgctgactccgttaaaggtcgcttcactatctctagagacaactctaagaatactctctacttgcagatgaacagcttaagggctgaggacacggccgtgtattactgtgcgagagagccgttactatggttcggggagttatcgtacaactggttcgacccctggggccagggcaccctggtcaccgtctcaagcggtggcggcggttcggggggtggcggaagtggaggtggagggagtcaagacatccagatgacccagtctccatcttccgtgtctgcatctgtaggagacagagtcaccatcacttgtcgggcgagtcagggtattagcagctggttagcctggtatcagcagaaaccagggaaagcccctaagctcctgatctatgctgcatccagtttgcaaagtggggtcccatcaaggttcagcggcagtggatctgggacagatttcactctcaccatcagcagcctgcagcctgaagattttgcaacttactattgtcaacaggctaacagtttccctctcactttcggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 770 - DNA, 1533 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctttttacggtatggcttgggttcgccaagctcctggtaaaggtttggagtgggtttcttctatctatccttctggtggctatactgattatgctgactccgttaaaggtcgcttcactatctctagagacaactctaagaatactctctacttgcagatgaacagcttaagggctgaggacacggccgtgtattactgtgcgagatccgcgggaggctggatcggggggggtgcttttgatatctggggccaagggacaatggtcaccgtctcaagcggtggcggcggttcggggggtggcggaagtggaggtggagggagtcagagcgaattgactcagccaccctcagcgtctgggacccccgggcagagggtcaccatctcttgttctggaagcagctccaacatcggaagtaatactgtaaactggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttatgtcttcggaattgggaccaaggtcaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 771 - DNA, 1541 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttggtactctatgtggtgggttcgccaagctcctggtaaaggtttggagtgggtttcttatatcgttccttctggtggcgagactatttatgctgactccgttaaaggtcgcttcactatctctagagacaactctaagaatactctctacttgcagatgaacagcttaagggctgaggacacggccgtgtattactgtgcgaaaaaccttggtgaaggattttggagtgattattaccctccgcttgactactggggccagggaaccctggtcaccgtctcaagcggtggcggcggttcggggggtggcggaagtggaggtggagggagtcagagcgtcttgactcagccaccctcagcgtctgggacccccgggcagagggtcaccatctcttgttctggaagcagctccaacatcggaggtaatgctgtaaactggtaccagcagctcccgggaacggcccccaaactcgtcctctatagtagtaatcaccggccctcaggggtccctgaccgattctctggctccaggtctggcacctcagcctccctggccatcagtgggctccagtctcaggatgaggctgattactactgtgcagcatgggatgacagcctgaatggtccgctcttcggcggagggaccaagctgaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 772 - DNA, 1514 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctcattacggtatgcattgggttcgccaagctcctggtaaaggtttggagtgggtttcttctatctatcctggcatgactcagtatgctgactccgttaaaggtcgcttcactatctctagagacaactctaagaatactctctacttgcagatgaacagcttaagggctgaggacacggccgtgtattactgtgcgagagatcggggttcggggattgatgcttttgatatctggggccaagggacaatggtcaccgtctcaagcggtggcggcggttcggggggtggcggaagtggaggtggagggagtcagagcgaattgactcagccaccctcagtgtccgtgtccccaggacagacggccaccgtcagctgctctggagaaaaattgggggatagatatgcctggtggtatcaacagaaggcaggccagtcccctgtgctggtcatctatcaagataccaagcggccctcaggggtccctgaccgattctctggctccaactctggcacctcagcctccctggtcatcagtggaccccagtctgaggatgaggctgattattactgtgcagcatgggatgacagcctgaagggtgtggtattcggcggagggtccaagctgaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 773 - DNA, 1541 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcctgcgctgcttccggattcactttctcttggtacgatatgctttgggttcgccaagctcctggtaaaggtttggagtgggtttctgttatctccccttctggtggccgtactttttatgctgactccgttaaaggtcgcttcactatctctagagacaactctaagaatactctctacttgcagatgaacagcttaagggctgaggacacggccgtgtattactgtgcggttactcgatcgatgtatagcagcagctggtacggggcccccccgactcactggggccagggcaccctggtcaccgtctcaagcggtggcggcggttcggggggtggcggaagtggaggtggagggagtcagagcgaattgactcagccaccctcagcgtctgggacccccgggcagagggtcaccatctcttgttctggaaggagctccaacatcggaagtaatagtgtaaactggtaccagcagctcccaggaacggcccccaaactcctcatctatagtaataatcaccggccctcaggggtccctgaccgattctctggctccaagtctggcacctcagcctccctggccatcagtgggctccagtctgaggatgaggctgattattactgtgcagcatgggatgacagcctgtatcaaggagtgttcggcggagggaccaagctgaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 774 - DNA, 1505 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttcttactggatgcattgggttcgccaagctcctggtaaaggtttggagtgggtttcttctatctatccttctggtggctctactgagtatgctgactccgttaaaggtcgcttcactatctctagagacaactctaagaatactctctacttgcagatgaacagcttaagggctgaggacacggccgtgtattactgtgcgaaaggaatctggttcgacccctggggccagggaaccctggtcaccgtctcaagcggtggcggcggttcggggggtggcggaagtggaggtggagggagtcaagacatccagatgacccagtctccagccaccctgtctgcctctgtaggagacagggtcaccatcacttgccggtcaagtcagaggattagcggctatttaaattggtatcagcagcaaccagggaaagcccctaagctcctgatctatgctgcatccaccttacaaagtggggtcccatcaaggatcagtggcagtggatctgggacagatttcagtctcatcatcagcagtctgcaacctgaagatgttgcaacttattattgtcaacagagttacagtcccccgttcacttttggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 775 - DNA, 1526 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctacttacgagatgaattgggttcgccaagctcctggtaaaggtttggagtgggtttctggtatcgttccttctggtggcgttacttattatgctgactccgttaaaggtcgcttcactatctctagagacaactctaagaatactctctacttgcagatgaacagcttaagggctgaggacacggccgtgtattactgtgcgaggggaccgtacagctatggtcacgactacggtatggacgtctggggccaagggaccacggtcaccgtctcaagcggtggcggcggttcggggggtggcggaagtggaggtggagggagtcaagacatccagatgacccagtctccttccaccctgtctgcatctgtaggagacagggtcaccatcacttgccgggccagtcagagtattagtagctggttggcctggtatcagcagaaaccagggaaagcccctaagctcctgatctataaggcgtctaatttagaaagtgaggtcccatcaaggttcagcggcagtggatctgggacagaattcactctcaccatcagcagcctgcagcctgatgattttgcaacttattactgccaacagtataatgcttatccattcattttcggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 776 - DNA, 1526 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttcttacactatgcattgggttcgccaagctcctggtaaaggtttggagtgggtttcttctatctctccttctggtggcatgactttttatgctgactccgttaaaggtcgcttcactatctctagagacaactctaagaatactctctacttgcagatgaacagcttaagggctgaggacactgcagtctactattgtgcgagaacttacgatttttggagtggttattttgactactggggccagggaactctggtcaccgtctcaagcggtggcggcggttcggggggtggcggaagtggaggtggagggagtcagagcgaattgactcagccaccctcggtatctgaagcccccaggcagagggtcaccgtctcctgttctggaagcccctccaacatcggaagtaattctgtaaactggtaccaacagctcccaggaaaggctcccaaagtcgtcatctattatgatgatctggtgccctcaggagtctctgaccgattctctggctccaagtctggcacttcagcctccctggccatcagtgggctccagtctgaggatgaggctgattattactgtgcagcatgggatgacaggctgaatggttgggtgttcggcggagggaccaagctgaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 777 - DNA, 1521 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctcttggtactggatgacttgggttcgccaagctcctggtaaaggtttggagtgggtttcttctatccctccttctggtggccatacttcttatgctgactccgttaaaggtcgcttcactatctctagagacaactctaagaatactctctacttgcagatgaacagcttaagggctgaggacacggccgtgtattactgtgctaaaagcagtggctggtacgaggactactttgactactggggccagggaaccctggtcaccgtctcaagcggtggcggcggttcggggggtggcggaagtggaggtggagggagtcaagacatccagatgacccagtctccatcctccctgtctgcctctgtaggagacagagtcaccatcacttgccaggcgagtcaagatattaccaactatttaaattggtatctgcataaaccagggaaagcccctaagctcctgatctacgacgcatccaacttgcaaacaggggtcccatcaaggttcagtggaagtggatctgggacagattttactttcaccatcactagcctgcagcctgaagattttggaacatattactgtcaacagtatgatactttacatccctctttcggccctgggaccacagtggatatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 778 - DNA, 1515 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctgcttactctatggtttgggttcgccaagctcctggtaaaggtttggagtgggtttcttatatctatccttctggtggcattactacttatgctgactccgttaaaggtcgcttcactatctctagagacaactctaagaatactctctacttgcagatgaacagcttaagggctgaggacacggctgtgtattactgtgcgagagagggccaggtttttgatatctggggccaagggaccacggtcaccgtctcaagcggtggcggcggttcggggggtggcggaagtggaggtggagggagtcaagacatccagatgacccagtctccagccaccctgtctttgtctccaggggaaagagccaccctctcctgcagggccagtcagagtgttaccacctacttagcctggtaccaacagagacctggccaggctcccaggctcctcatctatgatgcatccaacagggccactggcatcccagccaggttcagtggcagtgggtctgggacagacttcactctcaccatcagcagcgtagagcctgaagattatgcagtttattactgtcagcagcgtagcaactggcctccttcgatcaccttcggccaagggacacgactggagagtaagaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 779 - DNA, 1521 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctaattacgctatgggttgggttcgccaagctcctggtaaaggtttggagtgggtttctcgtatcgttccttctggtggcatgacttcttatgctgactccgttaaaggtcgcttcactatctctagagacaactctaagaatactctctacttgcagatgaacagcttaagggctgaggacacagccgtgtattactgtaccacagatgatttttggtccggtatggacgtctggggccaagggaccacggtcaccgtctcaagcggtggcggcggttcggggggtggcggaagtggaggtggagggagtcagagcgctttgactcagcctgcctccgtgtctgggtctcctggacagtcgatcaccatctcctgcactggaaccagcagtgatgttgggagttataaccttgtctcctggtaccaacagcacccaggcaaagcccccaaagtcatgatttatgagggcagtaagcggccctcaggggtttctaatcgcttctctggctccaagtctggcaacacggcctccctgacaatctctgggctccaggctgaggacgaggctgattattactgctgctcatatgcaggtcgtagcacttatgtcttcggaactgggaccaaggtcaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 780 - DNA, 1542 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctgcttacactatgcattgggttcgccaagctcctggtaaaggtttggagtgggtttcttctatctatccttctggtggcactactccttatgctgactccgttaaaggtcgcttcactatctctagagacaactctaagaatactctctacttgcagatgaacagcttaagggctgaggacacagccacatattactgtgccagagtggtgaatatcgatttttggagtggttacaatatgcggagtgcttttgatatctggggccaagggacaatggtcaccgtctcaagcggtggcggcggttcagggggtggcggaagtggaggtggagggagtcaagacatccagatgacccagtctccatcctccgtgtctgcgtctgtaggagacacagtcaccatcacttgtcgggcgagtcagggtgttagcgactggttagcctggtatcagcagaagccagggaaagcccctaacctcctaatctatggtgcatccagtctgcaaactggggtcccatcacggttcagcggcggtggatccgggacagatttcactctcaccatcagtagcctgcagcctgaggattttgcaacttactattgtcaacaggctcacagtttccctttcactttcggcggagggaccagggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 781 - DNA, 1524 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctgagtacggtatgtcttgggttcgccaagctcctggtaaaggtttggagtgggtttcttctatccgttcttctggtggctggactaagtatgctgactccgttaaaggtcgcttcactatctctagagacaactctaagaatactctctacttgcagatgaacagcttaagggctgaggacacggccgtgtattactgtgcgaaaggcctaggggccactagtggggaatttgactattggggccagggaaccctggtcaccgtctcaagcggtggcggcggttcggggggtggcggaagtggaggtggagggagtcaagacatccagatgacccagtctccaggcaccctgtctttgtctccaggggaaagagccaccctctcctgcagggccagtcagagtgttagcggcaactacttagcctggtaccagcagaaacttggccaggctcccaggctcctcatctatggtgcatccagcagggccactggcaccccagacaggttcagtggcagtgggtctgggacagaattcactctcacaatcagcagcctgcagcctgaagattttgcaacttattactgtctacagcataatagttatccgctcactttcggcgaagggaccaaggtggaaatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 782 - DNA, 1529 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctcagtactttatgatgtgggttcgccaagctcctggtaaaggtttggagtgggtttcttctatctctccttctggtggctatactcagtatgctgactccgttaaaggtcgcttcactatctctagagacaactctaagaatactctctacttgcagatgaacagcttaagggctgaggacacggccgtgtattactgtgcgaaaaccggtgactacacacgctactactcctacggtatggacgtctggggccagggaaccctggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcatcatcagcagtctgcaacctgaagattttgcaacttactactgtcaacagagttacagtaccccgctcactttcggcggagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgc

SEQ ID NO: 783 - DNA, 1533 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctggttactctatggcttgggttcgccaagctcctggtaaaggtttggagtgggtttctggtatctactcttctggtggctggacttggtatgctgactccgttaaaggtcgcttcactatctctagagacaactctaagaatactctctacttgcagatgaacagcttaagggctgaggacacagccgtgtattactgtacaagagaccaatctttctcctatgatagtagtcttgatgcttttgatatctggggccaagggacaatggtcaccgtctcaagcggtggcggcggttcggggggtggcggaagtggaggtggagggagtcaagacatccagatgacccagtctccatcctccctgtctgcatctgtaggagacagagtcaccatcacttgccgggcaagtcagagtattaacaactatttaaattggtatcagcagaaaccagggaaagcccctaagctcctgatctatactgcatccactttgcacagtggggtcccatcaaggttcagtggcagtggatctgggacagatttcactctcaccatcagcaatctgcaacctgaagattttgcaacttactactgtcaacagagttacgctaccctccggacgttcggccaagggaccaaggtggagatcaaaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 784 - DNA, 1539 bp, Artificial Sequence
  Made in a lab
aagcttgccgccatggattttcaagtgcagattttcagcttcctgctaatcagtgcttcagtcataatgtcgcgaggagaagttcaattgttagagtctggtggcggtcttgttcagcctggtggttctttacgtctttcttgcgctgcttccggattcactttctctctttacggtatgcattgggttcgccaagctcctggtaaaggtttggagtgggtttcttctatcgttccttctggtggccttactcgttatgctgactccgttaaaggtcgcttcactatctctagagacaactctaagaatactctctacttgcagatgaacagcttaagggctgaggacacagccacatattactgtgcgagactcgcgtattacgatttttggagtggtcgtgatgcttttgatatctggggccaagggacaatggtcaccgtctcaagcggtggcggcggttcggggggtggcggaagtggaggtggagggagtcagagcgtcttgactcagcctgcctccgtgtctgggtctcctggacagtcgatcaccatctcctgcagtggaagcagcagtgacgttggtcattatgactatgtctcctggtaccaacagcacccaggcaaggcccccaaactcatgatttatgatgtcagtaatcggccctcaggggtttctaatcgcttctctggctccaagtctggcaacacggcctccctgaccatctctgggctccaggctgacgacgaggctgagtattactgcagctcatatacaagcagcggcactcgagtcttcggaactgggaccaaggtcaccgtcctaaccggtgagcccaaatcttctgacaaaactcacacatgcccaccgtgcccagcacctgaagccgcgggtgcaccgtcagtcttcctcttccccccaaaacccaaggacaccctcatgatctcccggacccctgaggtcacatgcgtggtggtggacgtgagccacgaagaccctgaggtcaagttcaactggtacgtggacggcgtggaggtgcataatgccaagacaaagccgcgggaggagcagtacaacagcacgtaccgtgtggtcagcgtcctcaccgtcctgcaccaggactggctgaatggcaaggcgtacgcgtgcgcggtctccaacaaagccctcccagcccccatcgagaaaaccatctccaaagccaaagggcagccccgagaaccacaggtgtacaccctgcccccatcccgggatgagctgaccaagaaccaggtcagcctgacctgcctggtcaaaggcttctatccaagcgacatcgccgtggagtgggagagcaatgggcagccggagaacaactacaagaccacgcctcccgtgctggactccgacggctccttcttcctctacagcaagctcaccgtggacaagagccggtggcagcaggggaacgtcttctcatgctccgtgatgcatgaggctctgcacaaccactacacgcagaagagcctctccctgtctccgggtaaatgagcggccgca

SEQ ID NO: 785 - protein, 23 aa, Artificial Sequence
  Made in lab
  misc_feature (23)..(23): Xaa can be any naturally occurring amino acid
MDFQVQIFSFLLISASVIMSRGX

SEQ ID NO: 786 - protein, 20 aa, Artificial Sequence
  Made in lab
MEAPAQLLFLLLLWLPDTTG

SEQ ID NO: 787 - protein, 15 aa, Artificial Sequence
  Made in a lab
RASESVHNFGISFMN

SEQ ID NO: 788 - protein, 7 aa, Artificial Sequence
  Made in a lab
TASNQGS

SEQ ID NO: 789 - protein, 9 aa, Artificial Sequence
  Made in a lab
HQGKEVPWT

SEQ ID NO: 790 - protein, 15 aa, Artificial Sequence
  Made in a lab
RASESVGNFGISFVN

SEQ ID NO: 791 - protein, 7 aa, Artificial Sequence
  Made in a lab
AASNQGS

SEQ ID NO: 792 - protein, 9 aa, Artificial Sequence
  Made in a lab
QQSKEVPYT

SEQ ID NO: 793 - protein, 6 aa, Artificial Sequence
  Made in a lab
NTYAMN

SEQ ID NO: 794 - protein, 19 aa, Artificial Sequence
  Made in a lab
RTVTKSNKYATYYADSVSD

SEQ ID NO: 795 - protein, 9 aa, Artificial Sequence
  Made in a lab
EDYYGTLDY

SEQ ID NO: 796 - protein, 5 aa, Artificial Sequence
  Made in a lab
SYWMH

SEQ ID NO: 797 - protein, 17 aa, Artificial Sequence
  Made in a lab
EINPSNGRTNYNERFKS

SEQ ID NO: 798 - protein, 9 aa, Artificial Sequence
  Made in a lab
SDTKATCDY

SEQ ID NO: 799 - protein, 111 aa, Artificial Sequence
  Made in a lab
EIVLTQSPPSLAVSLGQRATISCRASESVHNFGISFMNWFQQKSGQPPKLLIYTASNQGSGVPARFSGRGSGTDFSLIIHPVEEDDTAMYFCHQGKEVPWTFGGGTKLEIK

SEQ ID NO: 800 - protein, 111 aa, Artificial Sequence
  Made in a lab
DIVLTQSPASLAVSLGQRATISCRASESVGNFGISFVNWFQQKPGQPPKLLIYAASNQGSGVPARFSGSGSGTDFSLNIHPMEEDDTAMYFCQQSKEVPYTFGGGTKLEIK

SEQ ID NO: 801 - protein, 111 aa, Artificial Sequence
  Made in a lab
EIVLTQSPATLSLSPGERATLSCRASESVHNFGISFMNWYQQKPGQAPRLLIYTASNQGSGIPARFSGSGSGTDFTLTISSLEPEDFAVYYCHQGKEVPWTFGQGTKVEIK

SEQ ID NO: 802 - protein, 111 aa, Artificial Sequence
  Made in a lab
DIVLTQSPASLAVSPGQRATITCRASESVHNFGISFMNWYQQKPGQPPKLLIYTASNQGSGVPARFSGSGSGTDFTLTINPVEANDTANYYCHQGKEVPWTFGQGTKVEIK

SEQ ID NO: 803 - protein, 111 aa, Artificial Sequence
  Made in a lab
EIVLTQSPATLSLSPGERATLSCRASESVGNFGISFVNWYQQKPGQAPRLLIYAASNQGSGIPARFSGSGSGTDFTLTISSLEPEDFAVYYCQQSKEVPYTFGQGTKLEIK

SEQ ID NO: 804 - protein, 111 aa, Artificial Sequence
  Made in a lab
DIQMTQSPSSLSASVGDRVTITCRASESVGNFGISFVNWYQQKPGKAPKLLIYAASNQGSGVPSRFSGSGSGTDFTLTISSLQPEDFATYYCQQSKEVPYTFGQGTKLEIK

SEQ ID NO: 805 - protein, 120 aa, Artificial Sequence
  Made in a lab
EVQLVESGGGLVQPKGTLRLSCAASGFSFNTYAMNWVRQAPGKSLEWVARTVTKSNKYATYYADSVSDRVTISREDSQSMLYLQMTNLKTEDTAMYYCVREDYYGTLDYWGQGTSVTVSS

SEQ ID NO: 806 - protein, 118 aa, Artificial Sequence
  Made in a lab
QVQLQQPGAELVKPGASVKLSCKASGYIFTSYWMHWVKQRPGQGLEWIGEINPSNGRTNYNERFKSKATLTVDKSSSTAYIQLSSLTSDDSAVYYCSRSDTKATCDYWGQGTTLTVSS

SEQ ID NO: 807 - protein, 120 aa, Artificial Sequence
  Made in a lab
EVQLVESGGGLVQPGGSLRLSCAASGFTFNTYAMNWVRQAPGKGLEWVGRTVTKSNKYATYYADSVSDRFTISRDDSKNSLYLQMNSLKTEDTAVYYCAREDYYGTLDYWGQGTLVTVSS

SEQ ID NO: 808 - protein, 120 aa, Artificial Sequence; identical to SEQ ID NO: 807
  Made in a lab

SEQ ID NO: 809 - protein, 118 aa, Artificial Sequence
  Made in a lab
QVQLVQSGAEVKKPGASVKVSCKASGYIFTSYWMHWVRQAPGQGLEWMGEINPSNGRTNYNERFKSRVTMTRDTSISTAYMELSRLRSDDTAVYYCARSDTKATCDYWGQGTTVTVSS

SEQ ID NO: 810 - protein, 118 aa, Artificial Sequence; identical to SEQ ID NO: 809
  Made in a lab

SEQ ID NO: 811 - DNA, 333 bp, Artificial Sequence
  Made in a lab
gagattgtgctgacccaatctccaccttctttggctgtgtctctggggcagagggccaccatctcctgcagagccagcgaaagtgttcataattttggcattagttttatgaactggtttcaacagaaatcaggacagccacccaaactcctcatctatactgcatccaaccaaggatccggggtccctgccaggtttagtggcagagggtctgggacagacttcagtctcatcatccaccctgtggaggaagatgatactgcaatgtatttctgtcaccaaggtaaggaggttccgtggacgttcggtggaggcaccaagctagaaatcaaa

SEQ ID NO: 812 - DNA, 333 bp, Artificial Sequence
  Made in a lab
gacattgtgctgacccaatctccagcttctttggctgtgtctctagggcagagggccaccatctcctgcagagccagcgaaagtgttggtaattttggcattagttttgtgaactggttccaacagaaaccaggacagccacccaaactcctcatctatgctgcctccaaccaaggatccggggtccctgccaggtttagtggcagtgggtctgggacagacttcagcctcaacatccatcctatggaggaggatgatactgcaatgtatttctgtcagcaaagtaaggaggttccgtacacgttcggaggggggaccaagctggaaataaaa

SEQ ID NO: 813 - DNA, 333 bp, Artificial Sequence
  Made in a lab
gaaattgtgttgacacagtctccagccaccctgtctttgtctccaggggaaagagccaccctctcctgcagagccagcgaaagtgttcataattttggcattagttttatgaactggtaccaacagaaacctggccaggctcccaggctcctcatctatactgcatccaaccaaggatccggcatcccagccaggttcagtggcagtgggtctgggacagacttcactctcaccatcagcagcctagagcctgaagattttgcagtttattactgtcaccaaggtaaggaggttccgtggacgttcggccaagggaccaaggtggaaatcaaa

SEQ ID NO: 814 - DNA, 333 bp, Artificial Sequence
  Made in a lab
gacattgtgctgacccagtctccagcctccttggccgtgtctccaggacagagggccaccatcacctgcagagccagcgaaagtgttcataattttggcattagttttatgaactggtatcagcagaaaccaggacaacctcctaaactcctgatttacactgcatccaaccaaggatccggggtcccagccaggttcagcggcagtgggtctgggaccgatttcaccctcacaattaatcctgtggaagctaatgatactgcaaattattactgtcaccaaggtaaggaggttccgtggacgttcggccaagggaccaaggtggaaatcaaa

SEQ ID NO: 815 - DNA, 333 bp, Artificial Sequence
  Made in a lab
gaaattgtgttgacacagtctccagccaccctgtctttgtctccaggggaaagagccaccctctcctgcagagccagcgaaagtgttggtaattttggcattagttttgtgaactggtaccaacagaaacctggccaggctcccaggctcctcatctatgctgcctccaaccaaggatccggcatcccagccaggttcagtggcagtgggtctgggacagacttcactctcaccatcagcagcctagagcctgaagattttgcagtttattactgtcagcaaagtaaggaggttccgtacacttttggccaggggaccaagctggagatcaag

SEQ ID NO: 816 - DNA, 334 bp, Artificial Sequence
  Made in a lab
gacatccagatgacccagtctccatcctccctgtctgcatctgtaggagacagagtcaccatcacttgcagagccagcgaaagtgttggtaattttggcattagttttgtgaactggtatcagcagaaaccagggaaagcccctaagctcctgatctatgctgcctccaaccaaggatccggggtcccatcaaggttcagtggcagtggatctgggacagatttcactctcaccatcagcagtctgcaacctgaagattttgcaacttactactgtcagcaaagtaaggaggttccgtacacttttggccaggggaccaagctggagatcaagt

SEQ ID NO: 817 - DNA, 360 bp, Artificial Sequence
  Made in a lab
gaggtgcagcttgttgagtctggtggaggattggtacagcctaaagggacattgagactctcatgtgccgcctctggattcagcttcaatacctatgccatgaactgggtccgccaggctccaggaaagagtttggagtgggttgctcgcacagtgactaaaagtaataagtatgcaacatattatgcagattcagtgagtgacagagtcaccatctccagagaggattcacaaagcatgctttatctgcaaatgaccaacttgaaaactgaggacacagccatgtattactgtgtgagagaagattactacggcactctggactactggggtcaaggaacctcagtcaccgtctcctca

SEQ ID NO: 818 - DNA, 354 bp, Artificial Sequence
  Made in a lab
caggtccaactgcagcagcctggggctgaactggtgaagcctggggcttctgtgaagctgtcctgcaaggcttctggctacatcttcaccagctactggatgcactgggtgaagcagaggcctggacaaggccttgagtggattggagagattaatcctagcaacggtcgtactaactacaatgagaggttcaagagcaaggccacactgactgtagacaaatcctccagcacagcctacattcaactcagcagcctgacatctgatgactctgcggtctattactgttcaagatcggatactaaggctacgtgtgactactggggccaaggcaccactctcacagtctcctca

SEQ ID NO: 819 - DNA, 360 bp, Artificial Sequence
  Made in a lab
gaggtgcagctggtggagtctgggggaggcttggtccagcctggagggtccctgagactctcctgtgcagcctctggattcaccttcaatacctatgccatgaactgggtccgccaggctccagggaaggggctggagtgggttggccgcacagtgactaaaagtaataagtatgcaacatattatgcagattcagtgagtgacagattcaccatctcaagagatgattcaaagaactcactgtatctgcaaatgaacagcctgaaaaccgaggacacggccgtgtattactgtgctagagaagattactacggcactctggactactggggccaaggaaccctggtcaccgtctcctca

SEQ ID NO: 820 - DNA, 360 bp, Artificial Sequence; identical to SEQ ID NO: 819
  Made in a lab

SEQ ID NO: 821 - DNA, 354 bp, Artificial Sequence
  Made in a lab
caggtgcagctggtgcagtctggggctgaggtgaagaagcctggggcctcagtgaaggtctcctgcaaggcttctggctacatcttcaccagctactggatgcactgggtgcgacaggcccctggacaagggcttgagtggatgggagagattaatcctagcaacggtcgtactaactacaatgagaggttcaagagcagggtcaccatgaccagggacacgtccatcagcacagcctacatggagctgagcaggctgagatctgacgacacggccgtgtattactgtgcgagatcggatactaaggctacgtgtgactactggggccaagggaccacggtcaccgtctcctct

SEQ ID NO: 822 - DNA, 354 bp, Artificial Sequence; identical to SEQ ID NO: 821
  Made in a lab

SEQ ID NO: 823 - protein, 21 aa, Artificial Sequence
  Made in a lab
QRHNNSSLNTGTQMAGHSPNS

SEQ ID NO: 824 - protein, 21 aa, Artificial Sequence
  Made in a lab
QRHNNSSLNTGTQKARHSPNS

SEQ ID NO: 825 - protein, 21 aa, Artificial Sequence
  Made in a lab
QRHNNSSLNTGTQMARHSPNS

SEQ ID NO: 826 - protein, 21 aa, Artificial Sequence
  Made in a lab
QRHNNSSLNTRTQKAGHSPNS

SEQ ID NO: 827 - protein, 21 aa, Artificial Sequence
  Made in a lab
QRHNNSSLNTRTQMAGHSPNS

SEQ ID NO: 828 - protein, 21 aa, Artificial Sequence
  Made in a lab
QRHNNSSLNTRTQMARHSPNS

SEQ ID NO: 829 - protein, 22 aa, Artificial Sequence
  Made in lab
MDFQVQIFSFLLISASVIMSRG

SEQ ID NO: 830 - protein, 10 aa, Human
EPKSCDKTHT

SEQ ID NO: 831 - protein, 7 aa, Human
ERKCCVE

SEQ ID NO: 832 - protein, 12 aa, Human
ELKTPLGDTTHT

SEQ ID NO: 833 - protein, 10 aa, Human
EPKSCDTPPP

SEQ ID NO: 834 - protein, 7 aa, Human
ESKYGPP

SEQ ID NO: 835 - protein, 5 aa, Human
CPPCP

SEQ ID NO: 836 - protein, 5 aa, Human
CPRCP

SEQ ID NO: 837 - protein, 5 aa, Human
CPSCP

SEQ ID NO: 838 - protein, 17 aa, Human
ELKTPLGDTTHTCPRCP

SEQ ID NO: 839 - protein, 15 aa, Human
EPKSCDTPPPCPRCP

SEQ ID NO: 840 - protein, 34 aa, Human
ESPKAQASSVPTAQPQAEGSLAKATTAPATTRNT

SEQ ID NO: 841 - protein, 24 aa, Human
GRGGEEKKKEKEKEEQEERETKTP

SEQ ID NO: 842 - protein, 19 aa, Human
VPSTPPTPSPSTPPTPSPS

SEQ ID NO: 843 - protein, 6 aa, Human
VPPPPP

SEQ ID NO: 844 - protein, 107 aa, Human
VCSRDFTPPTVKILQSSSDGGGHFPPTIQLLCLVSGYTPGTINITWLEDGQVMDVDLSTASTTQEGELASTQSELTLSQKHWLSDRTYTCQVTYQGHTFEDSTKKCA

SEQ ID NO: 845 - protein, 112 aa, Human
VIAELPPKVSVFVPPRDGFFGNPRKSKLICQATGFSPRQIQVSWLREGKQVGSGVTTDQVQAEAKESGPTTYKVTSTLTIKESDWLGQSMFTCRVDHRGLTFQQNASSMCVP

We claim:

1. An isolated polypeptide comprising a binding domain which can specifically bind to a human IL6/IL6R (IL6xR) complex, wherein the binding domain
   (a) specifically binds to the human IL6xR complex with a higher affinity than to either human IL6 or human IL6Rα alone;
   (b) can compete with a gp130 for binding to a soluble human IL6xR complex; and
   (c) comprises an antibody light chain variable region, wherein the antibody light chain variable region comprises CDR1, CDR2, and CDR3 sequences found in amino acids 649-758 of SEQ ID NO:608, and an antibody heavy chain variable region, wherein the antibody heavy chain variable region comprises CDR1, CDR2, and CDR3 sequences found in amino acids 512-631 of SEQ ID NO:608, and wherein the CDRs are defined by the Kabat, Chothia, AbM or contact definition.

2. The polypeptide of claim 1, wherein the antibody heavy chain variable region is at least 95% identical to amino acids 512-631 of SEQ ID NO:608 and the antibody light chain variable region is at least 95% identical to amino acids 649-758 of SEQ ID NO:608.

3. The polypeptide of claim 1, wherein the human IL6xR complex has an amino acid sequence consisting of the mature polypeptide sequence of SEQ ID NO:606.

4. The polypeptide of claim 1, wherein the binding domain does not inhibit signaling of human gp130 family cytokines other than human IL6.

5. The polypeptide of claim 1, wherein the binding domain comprises an antigen binding domain of an antibody, a scFv, or a Fab.

6. The polypeptide of claim 1 which comprises, from amino-terminus to carboxy-terminus: (i) the binding domain, (ii) a linker, and (iii) an antibody constant region, wherein the constant region comprises an immunoglobulin Fc domain or one or more CH domains of an immunoglobulin Fc domain.

7. The polypeptide of claim 6, wherein the linker is an immunoglobulin hinge region polypeptide.

8. The polypeptide of claim 6, wherein the linker is selected from SEQ ID NOs:497-604 or 823-828.

9. The polypeptide of claim 6, wherein the immunoglobulin Fc domain is an IgG1 Fc domain comprising mutations L234A, L235A, G237A, E318A, K320A, and K322A.

10. The polypeptide of claim 6, wherein the constant region lacks or has reduced antibody-dependent cell-mediated cytotoxicity (ADCC), antibody-dependent cell-mediated phagocytosis (ADCP), complement activation and complement-dependent cytotoxicity (CDC), or any combination thereof.

11. The polypeptide of claim 10, wherein the polypeptide binds to an FcRn receptor.

12. A composition comprising the polypeptide of claim 1 and a pharmaceutically acceptable carrier, diluent, or excipient.

* * * * *